US011377671B2

(12) United States Patent
Magalhaes et al.

(10) Patent No.: US 11,377,671 B2
(45) Date of Patent: Jul. 5, 2022

(54) CO-PRODUCTION PATHWAY FOR 3-HPA AND ACETYL-COA DERIVATIVES FROM MALONATE SEMIALDEHYDE

(71) Applicant: Braskem S.A., Sao Paulo (BR)

(72) Inventors: Beatriz Leite Magalhaes, Campinas (BR); Paulo Moises Raduan Alexandrino, Campinas (BR); Felipe Galzerani, Paulínia (BR)

(73) Assignee: BRASKEM S.A., Sao Paulo (BR)

( * ) Notice: Subject to any disclaimer, the term of this patent is extended or adjusted under 35 U.S.C. 154(b) by 32 days.

(21) Appl. No.: 16/719,833

(22) Filed: Dec. 18, 2019

(65) Prior Publication Data

US 2020/0216864 A1 Jul. 9, 2020

Related U.S. Application Data

(60) Provisional application No. 62/781,511, filed on Dec. 18, 2018.

(51) Int. Cl.
| | | |
|---|---|---|
| *C12P 7/42* | (2006.01) | |
| *C12N 1/16* | (2006.01) | |
| *C12N 1/18* | (2006.01) | |
| *C12R 1/865* | (2006.01) | |

(52) U.S. Cl.
CPC .................. *C12P 7/42* (2013.01); *C12N 1/16* (2013.01); *C12N 1/185* (2021.05); *C12R 2001/865* (2021.05); *C12Y 101/01* (2013.01); *C12Y 203/01009* (2013.01)

(58) Field of Classification Search
None
See application file for complete search history.

(56) References Cited

U.S. PATENT DOCUMENTS

| 2,469,701 | A | | 5/1949 | Redmon | |
|---|---|---|---|---|---|
| 8,048,624 | B1 | * | 11/2011 | Lynch | ...................... C12Q 1/68 435/6 |
| 8,198,481 | B2 | | 6/2012 | Kuppinger et al. | |
| 8,809,027 | B1 | | 8/2014 | Lynch et al. | |
| 8,846,353 | B2 | | 9/2014 | Tsobanakis et al. | |
| 10,358,664 | B2 | * | 7/2019 | Frias | .................... C12N 9/0006 |
| 2010/0021978 | A1 | | 1/2010 | Burk et al. | |
| 2014/0135526 | A1 | * | 5/2014 | Lynch | ...................... C12N 9/88 562/598 |
| 2018/0044684 | A1 | | 2/2018 | Jessen et al. | |
| 2018/0312886 | A1 | | 11/2018 | Lynch et al. | |

FOREIGN PATENT DOCUMENTS

| WO | WO-2011038364 | A1 | 3/2011 |
|---|---|---|---|
| WO | WO-2013043758 | A2 | 3/2013 |
| WO | WO-2016100910 | A1 | 6/2016 |
| WO | WO 2018/213349 | A1 | 11/2018 |
| WO | WO 2019/011945 | A1 | 1/2019 |
| WO | WO 2019/011948 | A1 | 1/2019 |

OTHER PUBLICATIONS

Fukui et al.,"Microbial synthesis of poly((R)-3-hydroxybutyrate-co-3-hydroxypropionate) from unrelated carbon sources by engineered Cupriavidus necator", Biomacromolecules 10: 700-706 (Year: 2009).*
International Search Report and Written Opinion for Application No. PCT/IB2019/001345, dated Jul. 7, 2020, 16 pages.
Alber et al., "Malonyl-Coenzyme A Reductase in the Modified 3-Hydroxypropionate Cycle for Autotrophic Carbon Fixation in Archaeal *Metallosphaera* and *Sulfolobus* spp.," Journal of Bacteriology, Dec. 2006, vol. 188, No. 24, pp. 8551-8559.
Andersen et al., "A gene duplication led to specialized γ-aminobutyrate and β-alanine aminotransferase in yeast," FEBS Journal, 2007, 274, 1804-1817.
Batra and Sharma, "Anti-cancer potential of flavonoids: recent trends and future perspectives," 3 Biotech (2013) 3: 439-459.
Carvalho et al., "Designing microorganisms for heterologous biosynthesis of cannabinoids," FEMS Yeast Research, (2017) 17, fox037, 11 pages.
Chu et al., "Direct fermentation route for the production of acrylic acid," Metabolic Engineering, 32 (2015), 23-29.
Erbilgin et al., "The Structural Basis of Coenzyme A Recycling in a Bacterial Organelle," PLoS Biol (2016) 14(3): e1002399, 20 pages.
Gogerty and Bobic, "Formation of Isobutene from 3-Hydroxy-3-Methylbutyrate by Diphosphomevalonate Decarboxylase," Applied and Enviromental Microbiology, Dec. 2010, vol. 76, No. 24, pp. 8004-8010.
Hiser et al., "ERG10 from *Saccharomyces cerevisiae* Encodes Acetoacetyl-CoA Thiolase," J Biol Chem, Dec. 1994, vol. 269, No. 50, pp. 31383-31389.
Johnson et al., "Design and application of genetically-encoded malonyl-CoA biosensors for metabolic engineering of microbial cell factories," Metabolic Engineering (2017) 44: 253-264.
Martinez et al., "Replacing *Escherichia coli* NAD-dependent glyceraldehyde 3-phosphate dehydrogenase (GAPDH) with a NADP-dependent enzyme from Clostridium acetobutylicum facilitates NADPH dependent pathways," Metabolic Engineering, 2008, 10(6):352-359.
Mou et al., "Transcriptomic Analysis Reveals Possible Influences of ABA on Secondary Metabolism of Pigments, Flavonoids and Antioxidants in Tomato Fruit during Ripening," PLoS ONE (2015) 10(6): e0129598, 26 pages.
Rathnasingh et al., "Production of 3-hydroxypropionic acid via malonyl-CoA pathway using recombinant *Escherichia coli* strains," Journal of Biotechnology, Feb. 2012, vol. 157, Issue 4, pp. 633-640.

(Continued)

*Primary Examiner* — Anand U Desai
(74) *Attorney, Agent, or Firm* — Morgan, Lewis & Bockius LLP

(57) ABSTRACT

The present disclosure provides methods for utilizing genetically modified microbes to co-produce 3-hydroxypropionic acid (3-HP) and acetyl-CoA, and derivatives thereof from malonate semialdehyde as a common single intermediate. The disclosure further provides modified microbe that co-produce the 3-HP and acetyl-CoA derivatives from malonate semialdehyde.

19 Claims, 25 Drawing Sheets

Specification includes a Sequence Listing.

(56) References Cited

OTHER PUBLICATIONS

Reinscheid et al., "Cloning, seguence analysis, expression and inactivation of the Corynebacterium glutamicum pta-ack operon encoding phosphotransacetylase and acetate kinase," Microbiology (1999) 145, 503-513.

Suyama et al., "Production of 3-hydroxypropionic acid via the malonyl-CoA pathway using recombinant fission yeast strains," Journal of Bioscience and Bioengineering, Oct. 2017, vol. 124, Issue 4, pp. 392-399.

Tamakawa et al., "Metabolic engineering of Candida utilis for isopropanol production." Appl Microbiol Biotechnol (2013) 97:6231-6239.

Wang et al., "Cloning and Characterization of Farnesyl Diphosphate Synthase Gene Involved in Triterpenoids Biosynthesis from Poria cocos," Int. J. Mol. Sci., 2014, 15, 22188-22202.

Wilding et al., "A β-Alanine Catabolism Pathway Containing a Highly Promiscuous ω-Transaminase in the 12-Aminododecanate-Degrading *Pseudomonas* sp. Strain AAC," Appl. Microbiol Biotechnol, 2016, 82(13): 3846-3856.

Yang and Cao, "Biosynthesis of phloroglucinol compounds in microorganisms-review," Appl Microbiol Biotechnology (2012) 93:487-495.

\* cited by examiner

Case 1-propanol + acetone, aerobic:

3 Glc + 1 O2 → 2 acetone + 2 1-propanol + 4 H2O + 6 CO2

1 Glc + 0.33 O2 → 0.67 acetone + 0.67 1-propanol + 1.33 H2O + 2 CO2

0.437 g/g Glc

Case 1-propanol + acetone, anaerobic:

5 Glc $\rightarrow$ 3 acetone + 4 1-propanol + 4 $H_2O$ + 9 $CO_2$

1 Glc $\rightarrow$ 0.6 acetone + 0.8 1-propanol + 0.8 $H_2O$ + 1.8 $CO_2$ 0.46 g/g Glc

Case 1-propanol + 2-propanol, aerobic:

6 Glc + 4.5 O2 → 5 2-propanol+ 2 1-propanol + 11 H2O + 15 CO2

1 Glc + 0.75 O2 → 0.83 2-propanol + 0.4 1-propanol + 2.2 H2O + 2.5 CO2

0.39 g/g Glc

Case 1-propanol + 2-propanol, anaerobic:

3 Glc → 2 2-Propanol + 2 1-propanol + 2 H2O + 6 CO2

1 Glc → 0.67 2-Propanol + 0.67 1-propanol + 0.67 H2O + 2 CO2

0.44 g/g Glc

Case 2-propanol, aerobic:

1 Glc + 1.5 O2 → 1 2-propanol + 3 H2O + 3 CO2

0.33 g/g Glc

Enzyme N°1
Km = 94 mM
Vm = 2,5 nM.min$^{-1}$.mg$^{-1}$

Enzyme N°6
Km = 13 mM
Vm = 2,5 nM.min$^{-1}$.mg$^{-1}$

Enzyme N°9
Km = 27 mM
Vm = 2,42 nM.min$^{-1}$.mg$^{-1}$

CO-PRODUCTION PATHWAY FOR 3-HPA AND ACETYL-COA DERIVATIVES FROM MALONATE SEMIALDEHYDE

CROSS-REFERENCE TO RELATED APPLICATION

This application claims priority to U.S. Provisional Application No. 62/781,511 filed Dec. 18, 2018, the contents of which are incorporated by reference in their entirety herein.

BACKGROUND OF THE DISCLOSURE

The disclosure relates generally to the production of commodity and specialty chemicals, and, more specifically, an integrated bioprocess for producing 3-hydroxypropionic acid (3-HP or 3-HPA) and acetyl-CoA derivatives from malonate semialdehyde (MSA).

Derivatives of 3-HP include acrylic acid, 1-propanol, propene, polypropylene, etc. Derivatives of acetyl-CoA include acetone, 2-propanol, propene, polypropylene, etc. Many of these molecules are produced via synthetic chemistry along with considerable amounts of chemical waste.

There exists a need to minimize chemical waste produced from production of these molecules to seek a more environmentally friendly and cost-effective approach for processes and molecules that utilize these 3-HP and acetyl-CoA derivatives.

As set forth herein, the disclosure provides methods and compositions for the fermentative co-production of 3-HP and acetyl-CoA derivatives.

STATEMENT REGARDING SEQUENCE LISTING

The sequence listing associated with this application is provided in text format in lieu of a paper copy, and is hereby incorporated by reference into the specification. The name of the text file containing the sequence listing is BRSK_020_01US_ST25.txt. The text file is 906 kb, and was created on Dec. 18, 2019, and is being submitted electronically.

SUMMARY OF THE DISCLOSURE

This disclosure provides a recombinant microorganism capable of co-producing 3-hydroxypropionic acid (3-HP) and acetyl-CoA, and/or derivatives thereof, from a feedstock comprising one or more carbon sources, wherein the recombinant microorganism comprises one or more of the following: (a) at least one endogenous and/or exogenous nucleic acid molecule encoding a 3-hydroxypropionic acid dehydrogenase that catalyzes the production of 3-HP from malonate semialdehyde; (b) at least one endogenous and/or exogenous nucleic acid molecule encoding a (i) malonate semialdehyde dehydrogenase that catalyzes the production of acetyl-CoA from malonate semialdehyde, and/or (ii) malonyl-CoA reductase and/or 2-keto acid decarboxylase that catalyzes the conversion of malonate semialdehyde into malonyl-CoA, and malonyl-CoA decarboxylase that catalyzes the production of acetyl-CoA from malonyl-CoA; (c) at least one endogenous and/or exogenous nucleic acid molecule encoding an enzyme that is able to catalyze the decarboxylation of oxaloacetate into malonate semialdehyde.

In some embodiments, the recombinant microorganism is capable of producing 1-propanol, wherein the recombinant microorganism comprises one or more of the following: (a) at least one endogenous and/or exogenous nucleic acid molecule encoding a propionyl-CoA synthase that catalyzes the conversion of 3-HP into propionyl-CoA; (b) at least one endogenous and/or exogenous nucleic acid molecule encoding a 3-hydroxypropionyl-CoA synthetase/CoA transferase, 3-hydroxypropionyl-CoA dehydratase, and acrylyl-CoA reductase that catalyzes the conversion of 3-HP into propionyl-CoA; (c) at least one endogenous and/or exogenous nucleic acid molecule encoding an alcohol/aldehyde dehydrogenase that catalyzes the conversion of propionyl-CoA from (a) or (b) into 1-propanol, or an aldehyde dehydrogenase (acetylating) and alcohol dehydrogenase that catalyzes together the production of 1-propanol from propionyl-CoA.

In some embodiments, the derivatives of 3-HP are selected from the group consisting of: acrylic acid, 1-propanol, propene, and polypropylene. In some embodiments, the derivatives of acetyl-CoA are selected from the group consisting of: acetone, 2-propanol, propene, and polypropylene. In some embodiments, at least a portion of excess NAD(P)H generated in the production of acetyl-CoA is utilized as a source of reducing equivalents in the production of 3-HP and/or 3-HP derivatives.

In some embodiments, the recombinant microorganism produces 3-hydroxypropionic acid (3-HP), acetyl-CoA, 1-propanol and/or 2-propanol, in an aerobic or anaerobic production process, preferably an anaerobic process.

In some embodiments, the microorganism is selected from a bacterium, a fungus, or a yeast. In some embodiments, the recombinant microorganism is derived from a parental microorganism selected from the group consisting of: *Clostridium* sp., *Clostridium ljungdahlii*, *Clostridium autoethanogenum*, *Clostridium ragsdalei*, *Eubacterium limosum*, *Butyribacterium methylotrophicum*, *Moorella thermoacetica*, *Clostridium aceticum*, *Acetobacterium woodii*, *Alkalibaculum bacchii*, *Clostridium drakei*, *Clostridium carboxidivorans*, *Candida* sp, *Clostridium formicoaceticum*, *Clostridium scatologenes*, *Moorella thermoautotrophica*, *Acetonema longum*, *Blautia producta*, *Clostridium glycolicum*, *Clostridium magnum*, *Clostridium mayombei*, *Clostridium methoxybenzovorans*, *Clostridium acetobutylicum*, *Clostridium beijerinckii*, *Candida krusei*, *Oxobacter pfennigii*, *Thermoanaerobacter kivui*, *Sporomusa ovata*, *Thermoacetogenium phaeum*, *Acetobacterium carbinolicum*, *Sporomusa termitida*, *Moorella glycerini*, *Eubacterium aggregans*, *Treponema azotonutricium*, *Escherichia coli*, *Saccharomyces cerevisiae*, *Pseudomonas putida*, *Bacillus* sp, *Corynebacterium* sp., *Yarrowia lipolytica*, *Scheffersomyces stipitis*, and *Terrisporobacter glycolicus*. In some embodiments, the recombinant microorganism is a yeast. In some embodiments, the yeast is *Saccharomyces cerevisiae*.

In some embodiments, the endogenous and/or exogenous nucleic acid molecule encoding a 3-hydroxypropionic acid dehydrogenase encodes an amino acid sequence comprising MCR-Nterm.Cau (SEQ ID NO: 105), ADH.Ae (SEQ ID NO: 106), MMSB.Bce (SEQ ID NO: 107), YDFG-0.Ec (SEQ ID NO: 108), YMR226C (YDF1) (SEQ ID NO: 109), or HPD1 (SEQ ID NO: 110). In some embodiments, the endogenous and/or exogenous nucleic acid molecule encoding a 3-hydroxypropionic acid dehydrogenase encodes an amino acid sequence comprising YMR226C (YDF1) (SEQ ID NO: 109). In some embodiments, the endogenous and/or exogenous nucleic acid molecule encoding a 3-hydroxypropionic acid dehydrogenase encodes an amino acid sequence comprising HPD1 (SEQ ID NO: 110).

In some embodiments, the endogenous and/or exogenous nucleic acid molecule encoding a malonate semialdehyde dehydrogenase encodes an amino acid sequence comprising MSD.Pa (SEQ ID NO: 111), MSD.Cal (SEQ ID NO: 112), iolA (SEQ ID NO: 113), iolA (SEQ ID NO: 114), iolA (SEQ ID NO: 115), mmsA (SEQ ID NO: 116), dddC (SEQ ID NO: 117), or iolA (SEQ ID NO: 118). In some embodiments, the endogenous and/or exogenous nucleic acid molecule encoding a malonate semialdehyde dehydrogenase encodes an amino acid sequence comprising MSD.Pa (SEQ ID NO: 111). In some embodiments, the endogenous and/or exogenous nucleic acid molecule encoding a malonate semialdehyde dehydrogenase encodes an amino acid sequence comprising MSD.Cal (SEQ ID NO: 112).

In some embodiments, the endogenous and/or exogenous nucleic acid molecule encoding a malonyl-CoA reductase and/or 2-keto acid decarboxylase encodes an amino acid sequence comprising mcr (SEQ ID NO: 278), matA, MLYCD (SEQ ID NO: 279), kivD (SEQ ID NO: 280), kdcA (SEQ ID NO: 281), ARO10 (SEQ ID NO: 282). In some embodiments, the endogenous and/or exogenous nucleic acid molecule encoding a malonyl-CoA reductase and/or 2-keto acid decarboxylase encodes an amino acid sequence comprising mcr (SEQ ID NO: 278). In some embodiments, the endogenous and/or exogenous nucleic acid molecule encoding a malonyl-CoA reductase and/or 2-keto acid decarboxylase encodes an amino acid sequence comprising kivD (SEQ ID NO: 280). In some embodiments, the endogenous and/or exogenous nucleic acid molecule encoding a malonyl-CoA reductase and/or 2-keto acid decarboxylase encodes an amino acid sequence comprising ARO10 (SEQ ID NO: 282).

In some embodiments, the at least one endogenous and/or exogenous nucleic acid molecule encoding an enzyme that is able to catalyze the decarboxylation of oxaloacetate into malonate semialdehyde encodes an amino acid sequence comprising (SEQ ID NO: 1) or (SEQ ID NO: 274). In some embodiments, the at least one endogenous and/or exogenous nucleic acid molecule encoding an enzyme that is able to catalyze the decarboxylation of oxaloacetate into malonate semialdehyde encodes an amino acid sequence comprising (SEQ ID NO: 1). In some embodiments, the at least one endogenous and/or exogenous nucleic acid molecule encoding an enzyme that is able to catalyze the decarboxylation of oxaloacetate into malonate semialdehyde encodes an amino acid sequence comprising (SEQ ID NO: 274).

In some embodiments, the recombinant microorganism comprises one or more of the following: (a) at least one endogenous and/or exogenous nucleic acid molecule encoding a thiolase or an acetyl-CoA acetyltransferase that catalyzes the production of acetoacetyl-CoA from acetyl-CoA; (b) at least one endogenous and/or exogenous nucleic acid molecule encoding an acetoacetyl-CoA synthase that catalyzes the production of acetoacetyl-CoA from malonyl-CoA; (c) at least one endogenous and/or exogenous nucleic acid molecule encoding an acetoacetyl-CoA transferase that catalyzes the production of acetoacetate from acetoacetyl-CoA; (d) at least one endogenous and/or exogenous nucleic acid molecule encoding a (i) hydroxymethylglutaryl-CoA synthase that catalyzes the production of HMG-CoA from acetoacetyl-CoA, and (ii) hydroxymethylglutaryl-CoA lyase that catalyzes the production of acetoacetate from HMG-CoA; and (e) at least one endogenous and/or exogenous nucleic acid molecule encoding an acetoacetate decarboxylase that catalyzes the production of acetone from acetoacetate.

In some embodiments, the endogenous and/or exogenous nucleic acid molecule encoding a thiolase or an acetyl-CoA acetyltransferase encodes an amino acid sequence comprising ERG10 (SEQ ID NO: 209), thlA (SEQ ID NO: 210), atoB (SEQ ID NO: 211), H16_B0759 (SEQ ID NO: 212), Msed_0656 (SEQ ID NO: 213), or AAT1 (SEQ ID NO: 214). In some embodiments, the endogenous and/or exogenous nucleic acid molecule encoding a thiolase or an acetyl-CoA acetyltransferase encode an amino acid sequence comprising ERG10 (SEQ ID NO: 209). In some embodiments, the endogenous and/or exogenous nucleic acid molecule encoding a acetoacetyl-CoA synthase encodes an amino acid sequence comprising nphT7 (SEQ ID NO: 285).

In some embodiments, the endogenous and/or exogenous nucleic acid molecule encoding a acetoacetyl-CoA transferase encodes an amino acid sequence comprising atoA/atoD (SEQ ID NO: 215 and 216), ctfA/ctfB (SEQ ID NO: 219 and 220), ctfA/ctfB (SEQ ID NO:221 and 222) or ctfA/ctfB (SEQ ID NO:223 and 224). In some embodiments, the endogenous and/or exogenous nucleic acid molecule encoding an acetoacetyl-CoA transferase encodes an amino acid sequence comprising atoA/atoD (SEQ ID NO: 215 and 216).

In some embodiments, the endogenous and/or exogenous nucleic acid molecule encoding a hydroxymethylglutaryl-CoA synthase and a hydroxymethylglutaryl-CoA lyase encode an amino acid sequence comprising ERG13 (SEQ ID NO: 283) and yngG (SEQ ID NO: 284). In some embodiments, the endogenous and/or exogenous nucleic acid molecule encoding a acetoacetate decarboxylase encodes an amino acid sequence comprising Adc.Ca (SEQ ID NO: 225), Adc.Cbe (SEQ ID NO: 226), Adc (SEQ ID NO: 227), Adc (SEQ ID NO: 228), Adc (SEQ ID NO: 229) or Adc.Pp (SEQ ID NO: 230). In some embodiments, the endogenous and/or exogenous nucleic acid molecule encoding a acetoacetate decarboxylase encodes an amino acid sequence comprising Adc.Pp (SEQ ID NO: 230).

The disclosure provides a method of co-producing 3-HP, and/or derivatives thereof and Acetyl-CoA and/or derivatives thereof by contacting the recombinant microorganism of any of the claim 1 or 2 with a fermentable carbon source under conditions and for a sufficient period of time to produce 3-HP, or derivatives and Acetyl-CoA or derivatives. In some embodiments, the carbon source is selected from sugars, glycerol, alcohols, organic acids, alkanes, fatty acids, lignocellulose, proteins, carbon dioxide, and carbon monoxide. In some embodiments, the recombinant microorganism produces 3-hydroxypropionic acid (3-HP), acetyl-CoA, 1-propanol and/or 2-propanol, in an aerobic or anaerobic production process, preferably an anaerobic process.

DETAILED DESCRIPTION OF THE DISCLOSURE

Figure 1:
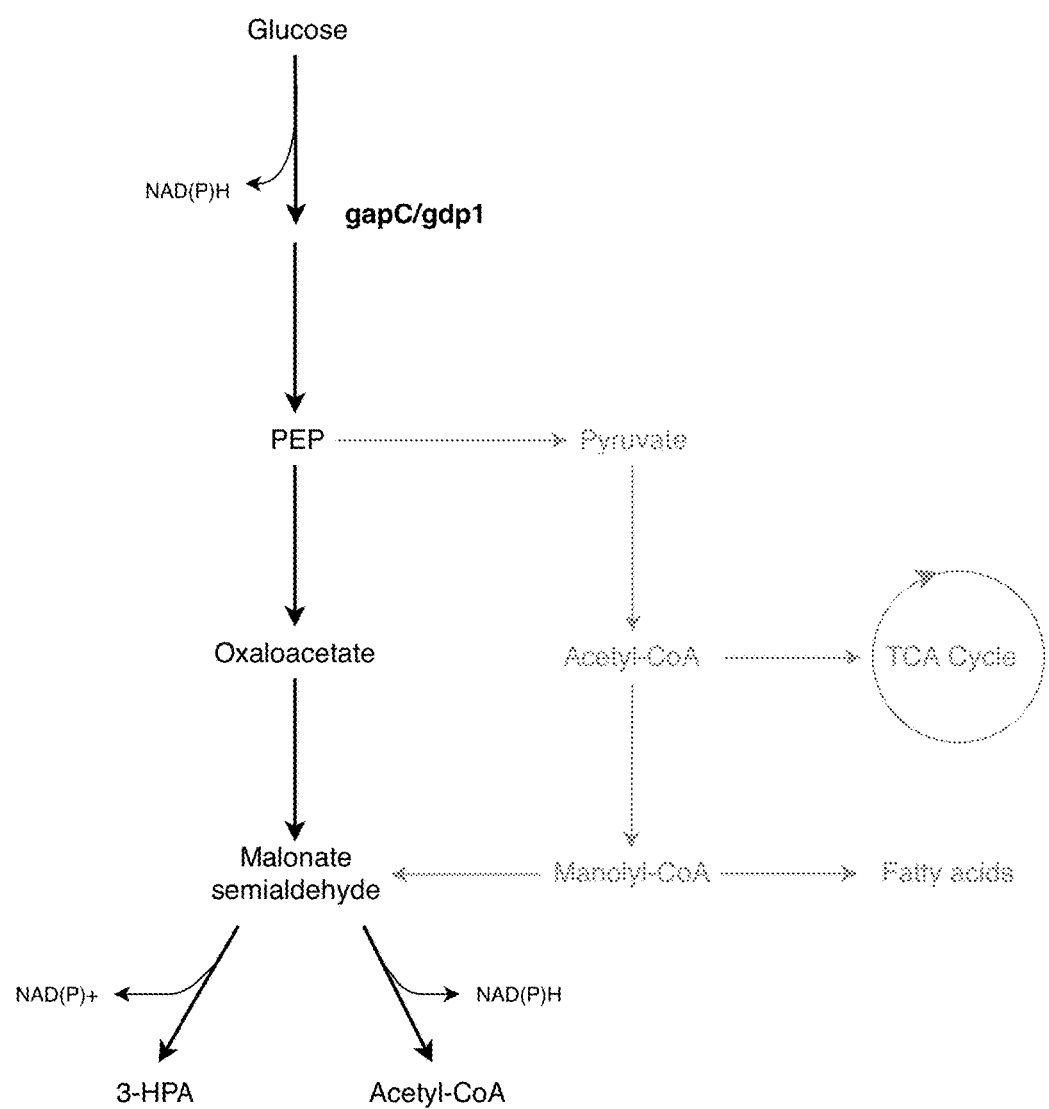
FIG. 1 depicts a novel combined pathway for 3-HP and acetyl-CoA production with malonate semialdehyde as a common single intermediate. The shaded offshoot identifies the usual pathway for malonate semialdehyde production with malonyl-CoA as an intermediate, which is replaced by a malonate semialdehyde in the present pathway.

The present disclosure is generally drawn to methods for utilizing genetically modified microbes to co-produce 3-hydroxypropionic acid (3-HP) and acetyl-CoA derivatives from malonate semialdehyde as a common single intermediate. The disclosure further provides modified microbe that co-produce the 3-HP and acetyl-CoA derivatives from malonate semialdehyde.

The co-production of 3-HP and acetyl-CoA, and derivatives thereof from malonate semialdehyde is novel, and the co-production results in a redox balanced set of pathways that co-produces the products at a high yield.

As used herein and in the appended claims, the singular forms "a," "an," and "the" include plural referents unless the context clearly dictates otherwise. Thus, for example, reference to "an enzyme" includes a plurality of such enzymes and reference to "the microorganism" includes reference to one or more microorganisms, and so forth.

As used herein, the terms "comprises," "comprising," "includes," "including," "has," "having," "contains," "containing," or any other variation thereof, are intended to cover a non-exclusive inclusion. A composition, mixture, process, method, article, or apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive "or" and not to an exclusive "or."

The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA (tRNA), ribosomal RNA (rRNA), short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

"Complementarity" refers to the ability of a nucleic acid to form hydrogen bond(s) with another nucleic acid sequence by either traditional Watson-Crick or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary, respectively). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions. Sequence identity, such as for the purpose of assessing percent complementarity, may be measured by any suitable alignment algorithm, including but not limited to the Needleman-Wunsch algorithm (see e.g. the EMBOSS Needle aligner available at www.ebi.ac.uk/Tools/psa/emboss needle/nucleotide.html, optionally with default settings), the BLAST algorithm (see e.g. the BLAST alignment tool available at blast.ncbi.nlm.nih.gov/Blast.cgi, optionally with default settings), or the Smith-Waterman algorithm (see e.g. the EMBOSS Water aligner available at www.ebi.ac.uk/Tools/psa/emboss water/nucleotide.html, optionally with default settings). Optimal alignment may be assessed using any suitable parameters of a chosen algorithm, including default parameters.

As used herein, "expression" refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell.

The terms "polypeptide", "peptide" and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics.

As used herein, the term "about" is used synonymously with the term "approximately." Illustratively, the use of the term "about" with regard to an amount indicates that values slightly outside the cited values, e.g., plus or minus 0.1% to 10%.

The term "biologically pure culture" or "substantially pure culture" refers to a culture of a microbe species described herein containing no other microbe species in quantities sufficient to interfere with the replication of the culture or be detected by normal microbiological techniques.

As used herein, a "control sequence" refers to an operator, promoter, silencer, or terminator.

As used herein, "introduced" refers to the introduction by means of modern biotechnology, and not a naturally occurring introduction.

As used herein, a "constitutive promoter" is a promoter, which is active under most conditions and/or during most development stages. There are several advantages to using constitutive promoters in expression vectors used in biotechnology, such as: high level of production of proteins used to select transgenic cells or organisms; high level of expression of reporter proteins or scorable markers, allowing easy detection and quantification; high level of production of a transcription factor that is part of a regulatory transcription system; production of compounds that requires ubiquitous activity in the organism; and production of compounds that are required during all stages of development.

As used herein, a "non-constitutive promoter" is a promoter which is active under certain conditions, in certain types of cells, and/or during certain development stages. For example, inducible promoters, and promoters under development control are non-constitutive promoters. As used herein, "inducible" or "repressible" promoter is a promoter which is under chemical or environmental factors control. Examples of environmental conditions that may affect transcription by inducible promoters include anaerobic conditions, certain chemicals, the presence of light, acidic or basic conditions, etc.

As used herein, the term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., that the coding sequence is under the transcriptional control of the promoter). Coding sequences can be operably linked to regulatory sequences in a sense or antisense orientation. In another example, the complementary RNA regions of the disclosure can be operably linked, either directly or indirectly, 5' to the target mRNA, or 3' to the target mRNA, or within the target mRNA, or a first complementary region is 5' and its complement is 3' to the target mRNA.

The term "signal sequence" as used herein refers to an amino acid sequence that targets peptides and polypeptides to cellular locations or to the extracellular environment. Signal sequences are typically at the N-terminal portion of a polypeptide and are typically removed enzymatically. Polypeptides that have their signal sequences are referred to as being full-length and/or unprocessed. Polypeptides that have had their signal sequences removed are referred to as being mature and/or processed.

The term "exogenous" as used herein with reference to various molecules, e.g., polynucleotides, polypeptides, enzymes, etc., refers to molecules that are not normally or naturally found in and/or produced by a given yeast, bacterium, organism, microorganism, or cell in nature. On the other hand, the term "endogenous" or "native" as used herein with reference to various molecules, e.g., polynucleotides, polypeptides, enzymes, etc., refers to molecules that are normally or naturally found in and/or produced by a given yeast, bacterium, organism, microorganism, or cell in nature.

The term "heterologous" as used herein in the context of a modified host cell refers to various molecules, e.g., polynucleotides, polypeptides, enzymes, etc., wherein at least one of the following is true: (a) the molecule(s) is/are foreign ("exogenous") to (i.e., not naturally found in) the host cell; (b) the molecule(s) is/are naturally found in (e.g., is "endogenous to") a given host microorganism or host cell but is either produced in an unnatural location or in an unnatural amount in the cell; and/or (c) the molecule(s) differ(s) in nucleotide or amino acid sequence from the endogenous nucleotide or amino acid sequence(s) such that the molecule differing in nucleotide or amino acid sequence from the endogenous nucleotide or amino acid as found endogenously is produced in an unnatural (e.g., greater than naturally found) amount in the cell.

The term "homolog," as used herein with respect to an original enzyme or gene of a first family or species, refers to distinct enzymes or genes of a second family or species which are determined by functional, structural, or genomic analyses to be an enzyme or gene of the second family or species which corresponds to the original enzyme or gene of the first family or species. Homologs most often have functional, structural, or genomic similarities. Techniques are known by which homologs of an enzyme or gene can readily be cloned using genetic probes and PCR. Identity of cloned sequences as homologs can be confirmed using functional assays and/or by genomic mapping of the genes.

A protein has "homology" or is "homologous" to a second protein if the amino acid sequence encoded by a gene has a similar amino acid sequence to that of the second gene.

Alternatively, a protein has homology to a second protein if the two proteins have "similar" amino acid sequences. Thus, the term "homologous proteins" is intended to mean that the two proteins have similar amino acid sequences. In certain instances, the homology between two proteins is indicative of its shared ancestry, related by evolution. The terms "homologous sequences" or "homologs" are thought, believed, or known to be functionally related. A functional relationship may be indicated in any one of a number of ways, including, but not limited to: (a) degree of sequence identity and/or (b) the same or similar biological function. Preferably, both (a) and (b) are indicated. The degree of sequence identity may vary, but in one aspect, is at least 50% (when using standard sequence alignment programs known in the art), at least 60%, at least 65%, at least 70%, at least 75%, at least 80%, at least 85%, at least 90%, at least about 91%, at least about 92%, at least about 93%, at least about 94%, at least about 95%, at least about 96%, at least about 97%, at least about 98%, or at least 98.5%, or at least about 99%, or at least 99.5%, or at least 99.8%, or at least 99.9%. Homology can be determined using software programs readily available in the art, such as those discussed in Current Protocols in Molecular Biology (F. M. Ausubel et al., eds., 1987) Supplement 30, section 7.718, Table 7.71. Some alignment programs are MacVector (Oxford Molecular Ltd, Oxford, U.K.) and ALIGN Plus (Scientific and Educational Software, Pennsylvania). Other non-limiting alignment programs include Sequencher (Gene Codes, Ann Arbor, Mich.), AlignX, and Vector NTI (Invitrogen, Carlsbad, Calif.). A similar biological function may include, but is not limited to: catalyzing the same or similar enzymatic reaction; having the same or similar selectivity for a substrate or co-factor; having the same or similar stability; having the same or similar tolerance to various fermentation conditions (temperature, pH, etc.); and/or having the same or similar tolerance to various metabolic substrates, products, by-products, intermediates, etc. The degree of similarity in biological function may vary, but in one aspect, is at least 1%, at least 2%, at least 3%, at least 4%, at least 5%, at least 6%, at least 7%, at least 8%, at least 9%, at least 10%, at least 20%, at least 30%, at least 40%, at least 50%, at least 60%, at least 65%, at least 70%, at least 75%, at least 80%, at least 85%, at least 90%, at least about 91%, at least about 92%, at least about 93%, at least about 94%, at least about 95%, at least about 96%, at least about 97%, at least about 98%, or at least 98.5%, or at least about 99%, or at least 99.5%, or at least 99.8%, or at least 99.9%, according to one or more assays known to one skilled in the art to determine a given biological function.

Genes of the present disclosure may be referenced with their common names, their nucleic acid sequences, and the amino acid sequences that are translated from the nucleic acid sequences. Using the references given in accession numbers for known genes, a practitioner is able to determine equivalent genes in other organisms, bacterial strains, yeast, fungi, mammals, plants, etc. This work is performed utilizing consensus sequences that can be determined by carrying out sequence alignments with genes derived from other microorganisms and designing degenerated probes to clone the corresponding gene in another organism.

As used herein, "overexpression" means that the expression of a gene or of an enzyme is increased as compared to the non-modified microorganism. Increasing the expression of an enzyme is obtained by increasing the expression of a gene encoding said enzyme. When a non-modified microorganism did not express a given gene, modifying said microorganism in order to express this gene is thus also considered as being an increase expression of said gene, and thus as an overexpression. Increasing the expression of a gene may be carried out by all techniques known by the one skilled in the art. In this regard, it may be notably cited the implementation of a strong promoter upstream the nucleic acid intended to be overexpressed or the introduction of a plurality of copies of the said nucleic acid between a promoter, especially a strong promoter, and a terminator.

As used herein, "inducible" promoter" means a promoter whose activity is induced, i.e. increased (1) in the presence of one or more particular metabolite(s)—the higher the metabolite concentration in the medium, the stronger the promoter activity; or (2) in the presence of a low concentration, or in the absence, of one or more metabolite(s). These metabolites are different from those whose increasing presence induces the activity of the promoter. The lower the metabolite concentration in the medium, the stronger the promoter activity.

As used herein, enzyme/protein "activity" and "function" are used interchangeably and designates, in the context of the disclosure, the capacity of (1) an enzyme to catalyze a desired reaction or (2) a protein to act in a certain manner.

As used herein, "aerobic conditions" refer to concentrations of oxygen in the culture medium that are sufficient for an aerobic or facultative anaerobic microorganism to use oxygen as a terminal electron acceptor.

As used herein, "anaerobic conditions" refer to culture or growth conditions with regard to the concentration of oxygen, which is intended to mean that the amount of oxygen is less than about 0% saturation of dissolved oxygen in liquid media. The term is also intended to include sealed chambers of liquid or solid media maintained with an atmosphere of less than about 0% oxygen.

As used herein, "microaerobic conditions" refer to concentrations of oxygen in the culture medium in which the concentration of oxygen is less than that in air under standard temperature and pressure, i.e., an oxygen concentration of up to ~6% of the total gas present.

The term "variant" refers to any polypeptide or enzyme described herein. A variant also encompasses one or more components of a multimer, multimers comprising an individual component, multimers comprising multiples of an individual component (e.g., multimers of a reference molecule), a chemical breakdown product, and a biological breakdown product. In particular, non-limiting aspect, an enzyme may be a "variant" relative to a reference enzyme by virtue of alteration(s) in any part of the polypeptide sequence encoding the reference enzyme. A variant of a reference enzyme can have enzyme activity of at least 10%, at least 30%, at least 50%, at least 80%, at least 90%, at least 100%, at least 105%, at least 110%, at least 120%, at least 130% or more in a standard assay used to measure enzyme activity of a preparation of the reference enzyme. In some aspects, a variant may also refer to polypeptides having at least 50%, at least 60%, at least 70%, at least 80%, at least 90%, at least 91%, at least 92%, at least 93%, at least 94%, at least 95%, at least 96%, at least 97%, at least 98%, or at least 99% sequence identity to the full-length, or unprocessed enzymes of the present disclosure. In some aspects, a variant may also refer to polypeptides having at least 50%, at least 60%, at least 70%, at least 80%, at least 90%, at least 91%, at least 92%, at least 93%, at least 94%, at least 95%, at least 96%, at least 97%, at least 98%, or at least 99% sequence identity to the mature, or processed enzymes of the present disclosure.

As used herein the terms "microorganism" or "microbe" should be taken broadly. These terms, used interchangeably, include but are not limited to, the two prokaryotic domains, Bacteria and Archaea.

As used herein, "isolate," "isolated," "isolated microbe," and like terms, are intended to mean that the one or more microorganisms has been separated from at least one of the materials with which it is associated in a particular environment (for example media, water, reaction chamber, etc.). Thus, an "isolated microbe" does not exist in its naturally occurring environment; rather, it is through the various techniques described herein that the microbe has been removed from its natural setting and placed into a non-naturally occurring state of existence. Thus, the isolated strain or isolated microbe may exist as, for example, a biologically pure culture, or as spores (or other forms of the strain). In aspects, the isolated microbe may be in association with an acceptable carrier, which may be a commercially or industrial acceptable carrier.

In certain aspects of the disclosure, the isolated microbes exist as "isolated and biologically pure cultures." It will be appreciated by one of skill in the art that an isolated and biologically pure culture of a particular microbe, denotes that said culture is substantially free of other living organisms and contains only the individual microbe in question. The culture can contain varying concentrations of said microbe. The present disclosure notes that isolated and biologically pure microbes often "necessarily differ from less pure or impure materials." See, e.g. In re *Bergstrom*, 427 F.2d 1394, (CCPA 1970) (discussing purified prostaglandins), see also, In re *Bergy*, 596 F.2d 952 (CCPA 1979) (discussing purified microbes), see also, *Parke-Davis & Co. v. H.K. Mulford & Co.*, 189 F. 95 (S.D.N.Y. 1911) (Learned Hand discussing purified adrenaline), aff'd in part, rev'd in part, 196 F. 496 (2d Cir. 1912), each of which are incorporated herein by reference. Furthermore, in some aspects, the disclosure provides for certain quantitative measures of the concentration, or purity limitations, that must be found within an isolated and biologically pure microbial culture. The presence of these purity values, in certain aspects, is a further attribute that distinguishes the presently disclosed microbes from those microbes existing in a natural state. See, e.g., *Merck & Co. v. Olin Mathieson Chemical Corp.*, 253 F.2d 156 (4th Cir. 1958) (discussing purity limitations for vitamin B12 produced by microbes), incorporated herein by reference.

Microbes of the present disclosure may include spores and/or vegetative cells. In some aspects, microbes of the present disclosure include microbes in a viable but non-culturable (VBNC) state. As used herein, "spore" or "spores" refer to structures produced by bacteria and fungi that are adapted for survival and dispersal. Spores are generally characterized as dormant structures; however, spores are capable of differentiation through the process of germination. Germination is the differentiation of spores into vegetative cells that are capable of metabolic activity, growth, and reproduction. The germination of a single spore results in a single fungal or bacterial vegetative cell. Fungal spores are units of asexual reproduction, and in some cases are necessary structures in fungal life cycles. Bacterial spores are structures for surviving conditions that may ordinarily be nonconductive to the survival or growth of vegetative cells.

As used herein, "microbial composition" refers to a composition comprising one or more microbes of the present disclosure.

As used herein, "carrier," "acceptable carrier," "commercially acceptable carrier," or "industrial acceptable carrier" refers to a diluent, adjuvant, excipient, or vehicle with which the microbe can be administered, stored, or transferred, which does not detrimentally effect the microbe.

The term "yield potential" as used herein refers to a yield of a product from a biosynthetic pathway. In one aspect, the yield potential may be expressed as a percent by weight of end product per weight of starting compound.

The term "thermodynamic maximum yield" as used herein refers to the maximum yield of a product obtained from fermentation of a given feedstock, such as glucose, based on the energetic value of the product compared to the feedstock. In a normal fermentation, without use of additional energy sources such as light, hydrogen gas or methane or electricity, for instance, the product cannot contain more energy than the feedstock. The thermodynamic maximum yield signifies a product yield at which all energy and mass from the feedstock is converted to the product. This yield can be calculated and is independent of a specific pathway. If a specific pathway towards a product has a lower yield than the thermodynamic maximum yield, then it loses mass and can most likely be improved upon or substituted with a more efficient pathway towards the product.

The term "redox balanced" refers to a set of reactions, which taken together produce as much redox cofactors as they consume. Designing metabolic pathways and engineering an organism such that the redox cofactors are balanced or close to being balanced usually results in a more efficient, higher yield production of the desired compounds. Redox reactions always occur together as two half-reactions happening simultaneously, one being an oxidation reaction and the other a reduction reaction. In redox processes, the reductant transfers electrons to the oxidant. Thus, in the reaction, the reductant or reducing agent loses electrons and is oxidized, and the oxidant or oxidizing agent gains electrons and is reduced. In one aspect, the redox reactions take place in a biological system. Biological energy is frequently stored and released by means of redox reactions. Photosynthesis involves the reduction of carbon dioxide into sugars and the oxidation of water into molecular oxygen. The reverse reaction, respiration, oxidizes sugars to produce carbon dioxide and water. As intermediate steps, the reduced carbon compounds are used to reduce nicotinamide adenine dinucleotide (NAD+), which then contributes to the creation of a proton gradient, which drives the synthesis of adenosine triphosphate (ATP) and is maintained by the reduction of oxygen. The term redox state is often used to describe the balance of GSH/GSSG, NAD+/NADH and NADP+/NADPH in a biological system such as a cell or organ. The redox state is reflected in the balance of several sets of metabolites (e.g., lactate and pyruvate, beta-hydroxybutyrate, and acetoacetate), whose interconversion is dependent on these ratios. An abnormal redox state can develop in a variety of deleterious situations, such as hypoxia, shock, and sepsis.

As used herein, the term "productivity" refers to the total amount of bioproduct (the products described herein) produced per hour.

As used herein "malonate semialdehyde," "malonic semialdehyde," and "3-oxopropanoic acid are used interchangeably to describe the C3H4O3 molecule of the present disclosure.

As used herein, "enhanced activity" of an enzyme designates either an increased specific catalytic activity of the enzyme, and/or an increased quantity/availability of the enzyme in the cell, obtained, for example, by overexpression of the gene encoding the enzyme.

The present application generally relates to methods of utilizing modified microbes for co-producing 3-hydroxypropionic acid (3-HP) and acetyl-CoA, and/or derivatives thereof; and further related to the modified microbes per se.

In some aspects, the present disclosure is drawn to a recombinant microorganism capable of co-producing 3-hydroxypropionic acid (3-HP) and acetyl-CoA, and/or derivatives thereof, from a feedstock comprising one or more carbon sources, wherein the recombinant microorganism comprises one or more of the following: (a) at least one endogenous and/or exogenous nucleic acid molecule encoding an 3-hydroxypropionic acid dehydrogenase that catalyzes the production of 3-HP from malonate semialdehyde; (b) at least one endogenous and/or exogenous nucleic acid molecule encoding a (i) malonate semialdehyde dehydrogenase that catalyzes the production of acetyl-CoA from malonate semialdehyde, and/or (ii) malonyl-CoA reductase and/or 2-keto acid decarboxylase that catalyzes the conversion of malonate semialdehyde into malonyl-CoA, and malonyl-CoA decarboxylase that catalyzes the production of acetyl-CoA from malonyl-CoA, and/or (iii) malonyl-CoA synthetase that catalyzes the conversion of oxaloacetate to malonyl-CoA, and malonyl-CoA decarboxylase that catalyzes the production of acetyl-CoA from malonyl-CoA; (c) at least one endogenous and/or exogenous nucleic acid molecule encoding an enzyme that is able to catalyze the decarboxylation of oxaloacetate into malonate semialdehyde.

In some aspects, the recombinant microorganism is capable of producing 1-propanol. In some aspects, the recombinant microorganism comprises one or more of the following: (a) at least one endogenous and/or exogenous nucleic acid molecule encoding a propionyl-CoA synthase that catalyzes the production of propionyl-CoA from 3-HP; (b) at least one endogenous and/or exogenous nucleic acid molecule encoding a 3-hydroxypropionyl-CoA synthetase/transferase, 3-hydroxypropionyl-CoA dehydratase, and acrylyl-CoA reductase that catalyzes the production of propionyl-CoA from 3-HP; (c) at least one endogenous and/or exogenous nucleic acid molecule encoding an alcohol/aldehyde dehydrogenase that catalyzes the production of 1-propanol from propionyl-CoA; (d) at least one endogenous and/or exogenous nucleic acid molecule encoding an aldehyde dehydrogenase (acetylating) that catalyzes the production of propionaldehyde from propionyl-CoA and alcohol dehydrogenase that catalyzes the production of 1-propanol from propionaldehyde.

In some aspects, the recombinant microorganism is capable of producing acetone. In some aspects, the recombinant microorganism comprises one or more of the following: (a) at least one endogenous and/or exogenous nucleic acid molecule encoding a thiolase or an acetyl-CoA acetyltransferase that catalyzes the production of acetoacetyl-CoA from acetyl-CoA; (b) at least one endogenous and/or exogenous nucleic acid molecule encoding an acetoacetyl-CoA synthase that catalyzes the production of acetoacetyl-CoA from malonyl-CoA; (c) at least one endogenous and/or exogenous nucleic acid molecule encoding an acetoacetyl-CoA transferase that catalyzes the production of acetoacetate from acetoacetyl-CoA; (d) at least one endogenous and/or exogenous nucleic acid molecule encoding a (i) hydroxymethylglutaryl-CoA synthase that catalyzes the production of HMG-CoA from acetoacetyl-CoA, and (ii) hydroxymethylglutaryl-CoA lyase that catalyzes the production of acetoacetate from HMG-CoA; and (e) at least one endogenous and/or exogenous nucleic acid molecule encoding an acetoacetate decarboxylase that catalyzes the production of acetone from acetoacetate.

In some aspects, the recombinant microorganism catalyzes malonate semialdehyde for the production of both 3-HP and acetyl-CoA, and/or derivatives thereof. In some aspects, the recombinant microorganism comprises a decarboxylase capable of acting on oxaloacetate to produce malonate semialdehyde. In some aspects, the derivatives of 3-HP are selected from the group consisting of: acrylic acid, 1-propanol, propene, and polypropylene. In some aspects, the derivatives of acetyl-CoA are selected from the group consisting of: acetone, 2-propanol, propene, and polypropylene.

In some aspects, at least a portion of excess NAD(P)H produced by the recombinant microorganism in the production of acetyl-CoA is utilized as a source of reducing equivalents in the production of 3-HP.

In some aspects, the microorganism is selected from a bacterium, a fungus, or a yeast. In some aspects, the recombinant microorganism is a yeast. In some aspects, the yeast is *Saccharomyces cerevisiae*. In some aspects, the yeast is capable of aerobic and anaerobic growth.

In some aspects, the recombinant microorganism is derived from a parental microorganism selected from the group consisting of: *Clostridium* sp., *Clostridium ljungdahlii*, *Clostridium autoethanogenum*, *Clostridium ragsdalei*, *Eubacterium limosum*, *Butyribacterium methylotrophicum*, *Moorella thermoacetica*, *Clostridium aceticum*, *Acetobacterium woodii*, *Alkalibaculum bacchii*, *Clostridium drakei*, *Clostridium carboxidivorans*, *Clostridium formicoaceticum*, *Clostridium scatologenes*, *Moorella thermoautotrophica*, *Acetonema longum*, *Blautia producta*, *Clostridium glycolicum*, *Clostridium magnum*, *Clostridium mayombei*, *Clostridium methoxybenzovorans*, *Clostridium acetobutylicum*, *Clostridium beijerinckii*, *Oxobacter pfennigii*, *Thermoanaerobacter kivui*, *Sporomusa ovata*, *Thermoacetogenium phaeum*, *Acetobacterium carbinolicum*, *Sporomusa termitida*, *Moorella glycerini*, *Eubacterium aggregans*, *Treponema azotonutricium*, *Escherichia coli*, *Saccharomyces cerevisiae*, *Pseudomonas putida*, *Bacillus* sp, *Candida* sp., *Candida krusei*, *Corynebacterium* sp., *Yarrowia lipolytica*, *Scheffersomyces stipitis*, and *Terrisporobacter glycolicus*.

In some aspects, the disclosure is drawn to a method of producing 3-hydroxypropionic acid (3-HP) and acetyl-CoA, and/or derivatives thereof, the method comprising culturing the recombinant microorganism in a culture medium containing a feedstock comprising a carbon source until the 3-hydroxypropionic acid (3-HP) and acetyl-CoA, and/or derivatives thereof, are produced.

In some aspects, the disclosure is drawn to a method of producing a recombinant microorganism capable of co-producing 3-hydroxypropionic acid (3-HP) and acetyl-CoA, and/or derivatives thereof, from a feedstock comprising one or more carbon sources, the method comprising introducing into and/or overexpressing in the recombinant microorganism one or more of the following: (a) at least one endogenous and/or exogenous nucleic acid molecule encoding an 3-hydroxypropionic acid dehydrogenase that catalyzes the production of 3-HP from malonate semialdehyde; (b) at least one endogenous and/or exogenous nucleic acid molecule encoding a (i) malonate semialdehyde dehydrogenase that catalyzes the production of acetyl-CoA from malonate semialdehyde, and/or or (ii) malonyl-CoA reductase and/or 2-keto acid decarboxylase that catalyzes the conversion of malonate semialdehyde into malonyl-CoA, and malonyl- CoA decarboxylase that catalyzes the production of acetyl-CoA from malonyl-CoA, and/or (iii) malonyl-CoA synthetase that catalyzes the conversion of oxaloacetate to malonyl-CoA, and malonyl-CoA decarboxylase that catalyzes the production of acetyl-CoA from malonyl-CoA; (c) at least one endogenous and/or exogenous nucleic acid molecule encoding an enzyme that is able to catalyze the decarboxylation of oxaloacetate into malonate semialdehyde.

In some aspects, the recombinant microorganism is capable of producing 1-propanol.

In some aspects, the method further comprises introducing into and/or overexpressing in the recombinant microorganism one or more of the following: (a) at least one endogenous and/or exogenous nucleic acid molecule encoding a propionyl-CoA synthase that catalyzes the production of propionyl-CoA from 3-HP; (b) at least one endogenous and/or exogenous nucleic acid molecule encoding a 3-hydroxypropionyl-CoA synthetase/transferase, 3-hydroxypropionyl-CoA dehydratase, and acrylyl-CoA reductase that catalyzes the production of propionyl-CoA from 3-HP; (c) at least one endogenous and/or exogenous nucleic acid molecule encoding an alcohol/aldehyde dehydrogenase that catalyzes the production of 1-propanol from propionyl-CoA; (d) at least one endogenous and/or exogenous nucleic acid molecule encoding an aldehyde dehydrogenase (acetylating) that catalyzes the production of propionaldehyde from propionyl-CoA and alcohol dehydrogenase that catalyzes the production of 1-propanol from propionaldehyde. In some aspects, the recombinant microorganism is capable of producing acetone. In some aspects, the method further comprises introducing into and/or overexpressing in the recombinant microorganism one or more of the following: (a) at least one endogenous and/or exogenous nucleic acid molecule encoding a thiolase or an acetyl-CoA acetyltransferase that catalyzes the production of acetoacetyl-CoA from acetyl-CoA; (b) at least one endogenous and/or exogenous nucleic acid molecule encoding an acetoacetyl-CoA synthase that catalyzes the production of acetoacetyl-CoA from malonyl-CoA; (c) at least one endogenous and/or exogenous nucleic acid molecule encoding an acetoacetyl-CoA transferase that catalyzes the production of acetoacetate from acetoacetyl-CoA; (d) at least one endogenous and/or exogenous nucleic acid molecule encoding a (i) hydroxymethylglutaryl-CoA synthase that catalyzes the production of HMG-CoA from acetoacetyl-CoA, and (ii) hydroxymethylglutaryl-CoA lyase that catalyzes the production of acetoacetate from HMG-CoA; and (e) at least one endogenous and/or exogenous nucleic acid molecule encoding an acetoacetate decarboxylase that catalyzes the production of acetone from acetoacetate.

In some aspects, the recombinant microorganism catalyzes malonate semialdehyde for the production of both 3-HP and acetyl-CoA, and/or derivatives thereof. In some aspects, the derivatives of 3-HP are selected from the group consisting of: acrylic acid, 1-propanol, propene, and polypropylene. In some aspects, the derivatives of acetyl-CoA are selected from the group consisting of: acetone, 2-propanol, propene, and polypropylene. In some aspects, at least a portion of excess NAD(P)H produced by the recombinant microorganism in the production of acetyl-CoA is utilized as a source of reducing equivalents in the production of 3-HP. In some aspects, the recombinant microorganism comprises a decarboxylase capable of acting on oxaloacetate to produce malonate semialdehyde.

In some aspects, the microorganism is selected from a bacterium, a fungus, or a yeast. In some aspects, the recombinant microorganism is a yeast. In some aspects, the yeast is capable of aerobic and anaerobic growth. In some aspects, the yeast is *Saccharomyces cerevisiae*.

In some aspects, the recombinant microorganism is derived from a parental microorganism selected from the group consisting of: *Clostridium* sp., *Clostridium ljungdahlii*, *Clostridium autoethanogenum*, *Clostridium ragsdalei*, *Eubacterium limosum*, *Butyribacterium methylotrophicum*, *Moorella thermoacetica*, *Clostridium aceticum*, *Acetobacterium woodii*, *Alkalibaculum bacchii*, *Clostridium drakei*, *Clostridium carboxidivorans*, *Clostridium formicoaceticum*, *Clostridium scatologenes*, *Moorella thermoautotrophica*, *Acetonema longum*, *Blautia producta*, *Clostridium glycolicum*, *Clostridium magnum*, *Clostridium mayombei*, *Clostridium methoxybenzovorans*, *Clostridium acetobutylicum*, *Clostridium beijerinckii*, *Oxobacter pfennigii*, *Thermoanaerobacter kivui*, *Sporomusa ovata*, *Thermoacetogenium phaeum*, *Acetobacterium carbinolicum*, *Sporomusa termitida*, *Moorella glycerini*, *Eubacterium aggregans*, *Treponema azotonutricium*, *Escherichia coli*, *Saccharomyces cerevisiae*, *Pseudomonas putida*, *Bacillus* sp, *Candida* sp *Candida krusei*, *Corynebacterium* sp., *Yarrowia lipolytica*, *Scheffersomyces stipitis*, and *Terrisporobacter glycolicus*.

Generation of Microbial Populations

Genetic Modification

The genetic modification introduced into one or more microbes of the present disclosure may alter or abolish a regulatory sequence of a target gene. In some aspects, the genetic modification introduced into one or more microbes of the present disclosure may introduce a new trait or phenotype into the one or more microbes. One or more regulatory sequences may also be inserted, including heterologous regulatory sequences and regulatory sequences found within a genome of an animal, plant, fungus, yeast, bacteria, or virus corresponding to the microbe into which the genetic variation is introduced. Moreover, regulatory sequences may be selected based on the expression level of a gene in a microbial culture. The genetic variation may be a pre-determined genetic variation that is specifically introduced to a target site. In some aspects the genetic variation is a nucleic acid sequence that is introduced into one or more microbial chromosomes. In some aspects, the genetic variation is a nucleic acid sequence that is introduced into one or more extrachromosomal nucleic acid sequence. The genetic variation may be a random mutation within the target site. The genetic variation may be an insertion or deletion of one or more nucleotides. In some cases, a plurality of different genetic variations (e.g. 2, 3, 4, 5, 10, or more) are introduced into one or more of the isolated bacteria. The plurality of genetic variations can be any of the above types, the same or different types, and in any combination. In some cases, a plurality of different genetic variations are introduced serially, introducing a first genetic variation after a first isolation step, a second genetic variation after a second isolation step, and so forth so as to accumulate a plurality of desired modifications in the microbes.

In general, the term "genetic variation" refers to any change introduced into a polynucleotide sequence relative to a reference polynucleotide, such as a reference genome or portion thereof, or reference gene or portion thereof. A genetic variation may be referred to as a "mutation," and a sequence or organism comprising a genetic variation may be referred to as a "genetic variant" or "mutant". Genetic variations can have any number of effects, such as the increase or decrease of some biological activity, including gene expression, metabolism, and cell signaling. Genetic variations can be specifically introduced to a target site, or introduced randomly. A variety of molecular tools and methods are available for introducing genetic variation. For example, genetic variation can be introduced via polymerase chain reaction mutagenesis, oligonucleotide-directed mutagenesis, saturation mutagenesis, fragment shuffling mutagenesis, homologous recombination, recombineering, lambda red mediated recombination, CRISPR/Cas9 systems, chemical mutagenesis, and combinations thereof. Chemical methods of introducing genetic variation include exposure of DNA to a chemical mutagen, e.g., ethyl methanesulfonate (EMS), methyl methanesulfonate (MMS), N-nitrosourea (EN U), N-methyl-N-nitro-N'-nitrosoguanidine, 4-nitroquinoline N-oxide, diethyl sulfate, benzopyrene, cyclophosphamide bleomycin, triethylmelamine, acrylamide monomer, nitrogen mustard, vincristine, diepoxyalkanes (for example, diepoxybutane), ICR-170, formaldehyde, procarbazine hydrochloride, ethylene oxide, dimethylnitrosamine, 7,12 dimethylbenz(a)anthracene, chlorambucil, hexamethylphosphoramide, bisulfan, and the like. Radiation mutation-inducing agents include ultraviolet radiation, γ-irradiation, X-rays, and fast neutron bombardment. Genetic variation can also be introduced into a nucleic acid using, e.g., trimethylpsoralen with ultraviolet light. Random or targeted insertion of a mobile DNA element, e.g., a transposable element, is another suitable method for generating genetic variation. Genetic variations can be introduced into a nucleic acid during amplification in a cell-free in vitro system, e.g., using a polymerase chain reaction (PCR) technique such as error-prone PCR. Genetic variations can be introduced into a nucleic acid in vitro using DNA shuffling techniques (e.g., exon shuffling, domain swapping, and the like). Genetic variations can also be introduced into a nucleic acid as a result of a deficiency in a DNA repair enzyme in a cell, e.g., the presence in a cell of a mutant gene encoding a mutant DNA repair enzyme is expected to generate a high frequency of mutations (i.e., about 1 mutation/100 genes-1 mutation/10,000 genes) in the genome of the cell. Examples of genes encoding DNA repair enzymes include but are not limited to Mut H, Mut S, Mut L, and Mut U, and the homologs thereof in other species (e.g., MSH 1 6, PMS 1 2, MLH 1, GTBP, ERCC-1, and the like). Example descriptions of various methods for introducing genetic variations are provided in e.g., Stemple (2004) Nature 5:1-7; Chiang et al. (1993) PCR Methods Appl 2(3): 210-217; Stemmer (1994) Proc. Natl. Acad. Sci. USA 91:10747-10751; and U.S. Pat. Nos. 6,033,861, and 6,773,900.

In some aspects, recombinant microbes of the present disclosure may comprise any one or more of the disclosed nucleic acid sequence listings. In some aspects, recombinant microbes of the present disclosure may comprise any one or more nucleic acid sequences that share at least 80%, at least 85%, at least 90%, at least 95%, at least 96%, at least 97%, at least 98%, or at least 99% sequence identity with any one or more of the disclosed nucleic acid sequence listings. In some aspects, recombinant microbes of the present disclosure may comprise any one or more nucleic acid sequence that shares at least about 80%, at least about 85%, at least about 90%, at least about 95%, at least about 96%, at least about 97%, at least about 98%, or at least about 99% sequence identity with any one or more of the disclosed nucleic acid sequence listings.

In some aspects, recombinant microbes of the present disclosure may comprise one or more nucleic acid sequences that encode one or more amino acid sequences of the present disclosure. In some aspects, recombinant microbes of the present disclosure may comprise one or more nucleic acid sequences that encode one or more amino acid sequences that share at least 80%, at least 85%, at least 90%, at least 95%, at least 96%, at least 97%, at least 98%, or at least 99% sequence identity with any one or more of the disclosed amino acid sequence listings. In some aspects, recombinant microbes of the present disclosure may comprise one or more nucleic acid sequences that encode one or more amino acid sequences that share at least about 80%, at least about 85%, at least about 90%, at least about 95%, at least about 96%, at least about 97%, at least about 98%, or at least about 99% sequence identity with any one or more of the disclosed amino acid sequence listings.

Genetic variations introduced into microbes may be classified as transgenic, cisgenic, intragenomic, intrageneric, intergeneric, synthetic, evolved, rearranged, or SNPs. CRISPR/Cas9 (Clustered regularly interspaced short palindromic repeats)/CRISPR-associated (Cas) systems can be used to introduce desired mutations. CRISPR/Cas9 provide bacteria and archaea with adaptive immunity against viruses and plasmids by using CRISPR RNAs (crRNAs) to guide the silencing of invading nucleic acids. The Cas9 protein (or functional equivalent and/or variant thereof, i.e., Cas9-like protein) naturally contains DNA endonuclease activity that depends on the association of the protein with two naturally occurring or synthetic RNA molecules called crRNA and tracrRNA (also called guide RNAs). In some cases, the two molecules are covalently link to form a single molecule (also called a single guide RNA ("sgRNA"). Thus, the Cas9 or Cas9-like protein associates with a DNA-targeting RNA (which term encompasses both the two-molecule guide RNA configuration and the single-molecule guide RNA configuration), which activates the Cas9 or Cas9-like protein and guides the protein to a target nucleic acid sequence. If the Cas9 or Cas9-like protein retains its natural enzymatic function, it will cleave target DNA to create a double-stranded break, which can lead to genome alteration (i.e., editing: deletion, insertion (when a donor polynucleotide is present), replacement, etc.), thereby altering gene expression. Some variants of Cas9 (which variants are encompassed by the term Cas9-like) have been altered such that they have a decreased DNA cleaving activity (in some cases, they cleave a single strand instead of both strands of the target DNA, while in other cases, they have severely reduced to no DNA cleavage activity). Further exemplary descriptions of CRISPR systems for introducing genetic variation can be found in, e.g. U.S. Pat. No. 879,596 and Di Carlo et al. (2013. Nucl. Acids Res., 7(41):4336-4343).

Oligonucleotide-directed mutagenesis, also called site-directed mutagenesis, typically utilizes a synthetic DNA primer. This synthetic primer contains the desired mutation and is complementary to the template DNA around the mutation site so that it can hybridize with the DNA in the gene of interest. The mutation may be a single base change (a point mutation), multiple base changes, deletion, or insertion, or a combination of these. The single-strand primer is then extended using a DNA polymerase, which copies the rest of the gene. The gene thus copied contains the mutated site, and may then be introduced into a host cell as a vector and cloned. Finally, mutants can be selected by DNA sequencing to check that they contain the desired mutation.

Genetic variations can be introduced using error-prone PCR. In this technique, the gene of interest is amplified using a DNA polymerase under conditions that are deficient in the fidelity of replication of sequence. The result is that the amplification products contain at least one error in the sequence. When a gene is amplified and the resulting product(s) of the reaction contain one or more alterations in sequence when compared to the template molecule, the resulting products are mutagenized as compared to the template. Another means of introducing random mutations is exposing cells to a chemical mutagen, such as nitrosoguanidine or ethyl methanesulfonate (Nestmann, Mutat Res 1975 June; 28(3):323-30), and the vector containing the gene is then isolated from the host.

Homologous recombination mutagenesis involves recombination between an exogenous DNA fragment and the targeted polynucleotide sequence. After a double-stranded break occurs, sections of DNA around the 5' ends of the break are cut away in a process called resection. In the strand invasion step that follows, an overhanging 3' end of the broken DNA molecule then "invades" a similar or identical DNA molecule that is not broken. The method can be used to delete a gene, remove exons, add a gene, and introduce point mutations. Homologous recombination mutagenesis can be permanent or conditional. Typically, a recombination template is also provided. A recombination template may be a component of another vector, contained in a separate vector, or provided as a separate polynucleotide. In some aspects, a recombination template is designed to serve as a template in homologous recombination, such as within or near a target sequence nicked or cleaved by a site-specific nuclease. A template polynucleotide may be of any suitable length, such as about or more than about 10, 15, 20, 25, 50, 75, 100, 150, 200, 500, 1000, or more nucleotides in length. In some aspects, the template polynucleotide is complementary to a portion of a polynucleotide comprising the target sequence. When optimally aligned, a template polynucleotide might overlap with one or more nucleotides of a target sequences (e.g. about or more than about 1, 5, 10, 15, 20, 25, 30, 35, 40, 45, 50, 60, 70, 80, 90, 100 or more nucleotides). In some aspects, when a template sequence and a polynucleotide comprising a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence. Non-limiting examples of site-directed nucleases useful in methods of homologous recombination include zinc finger nucleases, CRISPR nucleases, TALE nucleases, and meganuclease. For a further description of the use of such nucleases, see e.g. U.S. Pat. No. 8,795,965 and US20140301990.

Introducing genetic variation may be an incomplete process, such that some bacteria in a treated population of bacteria carry a desired mutation while others do not. In some cases, it is desirable to apply a selection pressure so as to enrich for bacteria carrying a desired genetic variation. Traditionally, selection for successful genetic variants involved selection for or against some functionality imparted or abolished by the genetic variation, such as in the case of inserting antibiotic resistance gene or abolishing a metabolic activity capable of converting a non-lethal compound into a lethal metabolite. It is also possible to apply a selection pressure based on a polynucleotide sequence itself, such that only a desired genetic variation need be introduced (e.g. without also requiring a selectable marker). In this case, the selection pressure can comprise cleaving genomes lacking the genetic variation introduced to a target site, such that selection is effectively directed against the reference sequence into which the genetic variation is sought to be introduced. Typically, cleavage occurs within 100 nucleotides of the target site (e.g. within 75, 50, 25, 10, or fewer nucleotides from the target site, including cleavage at or within the target site). Cleaving may be directed by a site-specific nuclease selected from the group consisting of a Zinc Finger nuclease, a CRISPR nuclease, a TALE nuclease (TALEN), or a meganuclease. Such a process is similar to processes for enhancing homologous recombination at a target site, except that no template for homologous recombination is provided. As a result, bacteria lacking the desired genetic variation are more likely to undergo cleavage that, left unrepaired, results in cell death. Bacteria surviving selection may then be isolated for assessing conferral of an improved trait.

A CRISPR nuclease may be used as the site-specific nuclease to direct cleavage to a target site. An improved selection of mutated microbes can be obtained by using Cas9 to kill non-mutated cells. Microbes can then be re-isolated from tissues. CRISPR nuclease systems employed for selection against non-variants can employ similar elements to those described above with respect to introducing genetic variation, except that no template for homologous recombination is provided. Cleavage directed to the target site thus enhances death of affected cells.

Other options for specifically inducing cleavage at a target site are available, such as zinc finger nucleases, TALE nuclease (TALEN) systems, and meganuclease. Zinc-finger nucleases (ZFNs) are artificial DNA endonucleases generated by fusing a zinc finger DNA binding domain to a DNA cleavage domain. ZFNs can be engineered to target desired DNA sequences and this enables zinc-finger nucleases to cleave unique target sequences. When introduced into a cell, ZFNs can be used to edit target DNA in the cell (e.g., the cell's genome) by inducing double stranded breaks. Transcription activator-like effector nucleases (TALENs) are artificial DNA endonucleases generated by fusing a TAL (Transcription activator-like) effector DNA binding domain to a DNA cleavage domain. TALENS can be quickly engineered to bind practically any desired DNA sequence and when introduced into a cell, TALENs can be used to edit target DNA in the cell (e.g., the cell's genome) by inducing double strand breaks. Meganucleases (homing endonuclease) are endodeoxyribonucleases characterized by a large recognition site (double-stranded DNA sequences of 12 to 40 base pairs. Meganucleases can be used to replace, eliminate or modify sequences in a highly targeted way. By modifying their recognition sequence through protein engineering, the targeted sequence can be changed. Meganucleases can be used to modify all genome types, whether bacterial, plant or animal and are commonly grouped into four families: the LAGLIDADG family, the GIY-YIG family, the His-Cyst box family and the HNH family. Exemplary homing endonucleases include I-SceI, I-CeuI, PI-PspI, PI-Sce, I-SceIV, I-CsmI, I-PanI, I-SceII, I-PpoI, I-SceIII, I-CreI, I-TeeI, I-TevII and I-TevIII.

In some aspects, methods of enhancing expression of endogenous or exogenous genes is to introduce one or more supplementary copies of the gene into a chromosome or plasmid. In some aspects, another way of enhancing expression of endogenous or exogenous genes is to replace the endogenous promoter of a gene with, or to use an exogenous promoter of a gene, a stronger promoter. In some aspects, the promoters are homologous or heterologous.

In some aspects, the microbes of the present disclosure are modified such that they comprise one or more selectable markers useful for the selection of transformed microbial cells. In some aspects, the selectable markers are introduced via DNA constructs comprising the genes, polynucleotides, oligonucleotides, and/or pathways of the present disclosure.

In some aspects, the selectable marker is an antibiotic resistance marker. Illustrative examples of antibiotic resistance markers include, but are not limited to the, NAT 1, AUR1-C, HPH, DSDA, KAN<R>, and SH BLE gene products. The NAT 1 gene product from *S. noursei* confers resistance to nourseothricin; the AUR1-C gene product from *Saccharomyces cerevisiae* confers resistance to Auerobasidin A (AbA); the HPH gene product of *Klebsiella pneumonia* confers resistance to Hygromycin B; the DSDA gene product of *E. coli* allows cells to grow on plates with D-serine as the sole nitrogen source; the KAN<R> gene of the Tn903 transposon confers resistance to G418; and the SH BLE gene product from *Streptoalloteichus hindustanus* confers resistance to Zeocin (bleomycin). In some aspects, the antibiotic resistance marker is deleted after the genetically modified microbial cell of the present disclosure is isolated.

In some aspects, the selectable marker rescues an auxotrophy (e.g., a nutritional auxotrophy) in the genetically modified microbial cell. In such aspects, a parent microbial cell comprises a functional disruption in one or more gene products that function in an amino acid or nucleotide biosynthetic pathway, such as, for example, the HIS3, LEU2, LYS1, LYS2, MET 15, TRP1, ADE2, and URA3 gene products in yeast, which renders the parent microbial cell incapable of growing in media without supplementation with one or more nutrients (auxotrophic phenotype). The auxotrophic phenotype can then be rescued by transforming the parent microbial cell with a chromosomal integration encoding a functional copy of the disrupted gene product (NB: the functional copy of the gene can originate from close species, such as *Kluveromyces, Candida* etc.), and the genetically modified microbial cell generated can be selected for based on the loss of the auxotrophic phenotype of the parent microbial cell.

When a gene from a different type of microorganism is introduced into a cell (yeast gene to bacteria, bacterial gene to yeast, viral gene to yeast, etc), the gene may be transcoded (codon-optimized) such that the genes are synthesized with an optimal codon usage for expression in the host to which the gene is being introduced. In some aspects, the nucleotide sequence (and not the amino acid sequence) of some genes may be transcoded to minimize recombination with an endogenous copy of the same gene or homolog. In some aspects, the gene may be rendered inducible by deleting the endogenous copy of the gene, if necessary, and placing a new copy of the gene under the control of an inducible promoter.

In some aspects, the disclosure is drawn to a nucleic acid sequence encoding an enzyme capable of catalyzing the decarboxylation of oxaloacetate into malonate semialdehyde, or one of its salts, and can be expressed in a microbe using to types of non-mutually exclusive manners: (1) overexpression, i.e., one or a plurality of copies is/are introduced into the microorganism; and/or (2) the at least one nucleic acid is placed under the control of a strong or inducible promoter.

Promoters

In some aspects, various promoters may be used for the desired expression of the coding sequences of interest, which include (i) constitutive strong promoters (sometimes referred to as strong promoters), and (ii) inducible promoters.

In some aspects, the promoters are yeast promoters. A list of yeast promoters with their relative activities in different media can be found in Keren et al. (2013. Molecular Systems Biology, 9:701). Promoters allowing the constitutive over-expression of a given gene, may be found in Velculescu et al. (1997. Cell, 88:243-251).

In some aspects, strong promoters may be selected from the following: pTDH3 (SEQ ID NO: 13), pENO2 (SEQ ID NO: 14), pTEF KI (SEQ ID NO: 15), pTEF3 (SEQ ID NO: 16), pTEF1 (SEQ ID NO: 17), pADH1 (SEQ ID NO: 18), pGMP1 (SEQ ID NO: 19), pFBA1 (SEQ ID NO: 20), pPDC1 (SEQ ID NO: 21), pCCW12 (SEQ ID NO: 22), and pGK1 (SEQ ID NO: 23).

In some aspects, the strong promoter according to the disclosure is, independently, selected from the group consisting of pTDH3, pENO2, pTEF-KI, pTEF3, pTEF1, pADH1, pGMP1, pFBA1, pPDC1, pCCW12 and pGK1.

As described herein, inducible promoters are promoters whose activity is controlled by the presence or absence of biotic or abiotic factors, and also by the quantity of said factor. Accordingly, their activity will be induced and thus increased when the quantity of a given factor increases or is increased.

In some aspects, increasing the quantity of methionine in a culture medium of a recombinant yeast comprising a pSAM4 promoter will induce and thus increase transcription of the gene under the control of this promoter. In some aspects, reducing the quantity of copper in a culture medium of a recombinant yeast comprising a pCTR1 promoter will lead to an induced, and thus an increased, transcription of the gene under the control of this promoter.

For this reason, the following promoters are referred to in the present text as being "inducible promoters."

In some aspects, inducible promoters may be selected from the group comprising promoters inducible with copper, promoters inducible with methionine and promoters inducible with threonine, and may be selected from the group consisting of: pSAM4—methionine inducible (SEQ ID NO: 24), pCUP1-1—copper inducible (SEQ ID NO: 25), pCUP1.cgla—copper inducible (SEQ ID NO: 26), pCUP1.sba—copper inducible (SEQ ID NO: 27), pACU1—copper inducible (SEQ ID NO: 28), pACU2—copper inducible (SEQ ID NO: 29), pACU3p—copper inducible (SEQ ID NO: 30), pACU4p—copper inducible (SEQ ID NO: 31), pACU5—copper inducible (SEQ ID NO: 32), pACU6—copper inducible (SEQ ID NO: 33), pACU7—copper inducible (SEQ ID NO: 34), pACU8—copper inducible (SEQ ID NO: 35), pACU9—copper inducible (SEQ ID NO: 36), pACU10p—copper inducible (SEQ ID NO: 37), pACU11—copper inducible (SEQ ID NO: 38), pACU12—copper inducible (SEQ ID NO: 39), pACU13—copper inducible (SEQ ID NO: 40), pACU14—copper inducible (SEQ ID NO: 41), pACU15—copper inducible (SEQ ID NO: 42), pGAL/CUP1p—copper inducible (SEQ ID NO: 43), pCRS5—copper inducible (SEQ ID NO: 44), and pCHA1—threonine inducible (SEQ ID NO: 45).

In some aspects, the inducible promoter(s) may be selected from the group consisting of pSAM4, pCUP1-1, pCUP1.Cgla, pCUP1.Sba, pACU1, pACU2, pACU3p, pACU4p, pACU5, pACU6, pACU7, pACU8, pACU9, pACU10p, pACU11, pACU12, pACU13, pACU14, pACU15, pGAL/CUP1p, pCRS5, and pCHA1. The activity of these promoters is thus induced by the increasing presence of methionine, copper or threonine as indicated above.

In some aspects, inducible promoters may be selected from: (1) promoters inducible due to the absence of copper (i.e. promoter's activity is increased by the absence of copper—the fewer copper there is in the medium, the higher the activity of these promoters); (2) promoters inducible due to the absence of lysine (i.e. promoter's activity is increased by the absence of lysine—the fewer lysine there is in the medium, the higher the activity of these promoters); and (3) promoters inducible due to the absence of methionine (i.e. promoter's activity is increased by the absence of methionine—the fewer methionine there is in the medium, the higher the activity of these promoters). In some aspects, the inducible promoters are selected from the group consisting of: pCTR1—copper inducible (SEQ ID NO: 46), pCTR3—copper inducible (SEQ ID NO: 47), pCUR1—copper inducible (SEQ ID NO: 48), pCUR2—copper inducible (SEQ ID NO: 49), pCUR3—copper inducible (SEQ ID NO: 50), pCUR4—copper inducible (SEQ ID NO: 51), pCUR5p—copper inducible (SEQ ID NO: 52), pCUR6—copper inducible (SEQ ID NO: 53), pCUR7—copper inducible (SEQ ID NO: 54), pCUR8—copper inducible (SEQ ID NO: 55), pCUR9—copper inducible (SEQ ID NO: 56), pCUR10—copper inducible (SEQ ID NO: 57), pCUR11—copper inducible (SEQ ID NO: 58), pCUR12—copper inducible (SEQ ID NO: 59), pCUR13—copper inducible (SEQ ID NO: 60), pCUR14—copper inducible (SEQ ID NO: 61), pCUR15—copper inducible (SEQ ID NO: 62), pCUR16—copper inducible (SEQ ID NO: 63), pCUR17—copper inducible (SEQ ID NO: 64), pLYS1—lysine inducible (SEQ ID NO: 65), pLYS4—lysine inducible (SEQ ID NO: 66), pLYS9—lysine inducible (SEQ ID NO: 67), pLYR1p—lysine inducible (SEQ ID NO: 68), pLYR2p—lysine inducible (SEQ ID NO: 69), pLYR3p—lysine inducible (SEQ ID NO: 70), pLYR4p—lysine inducible (SEQ ID NO: 71), pLYR5p—lysine inducible (SEQ ID NO: 72), pLYR6p—lysine inducible (SEQ ID NO: 73), pLYR7p—lysine inducible (SEQ ID NO: 74), pLYR8—lysine inducible (SEQ ID NO: 75), pLYR9—lysine inducible (SEQ ID NO: 76), pLYR10—lysine inducible (SEQ ID NO: 77), pLYR11—lysine inducible (SEQ ID NO: 78), pMET17—methionine inducible (SEQ ID NO: 79), pMET6—methionine inducible (SEQ ID NO: 80), pMET14—methionine inducible (SEQ ID NO: 81), pMET3—methionine inducible (SEQ ID NO: 82), pSAM1—methionine inducible (SEQ ID NO: 83), pSAM2—methionine inducible (SEQ ID NO: 84), pMDH2—glucose inducible (SEQ ID NO: 85), pJEN1—glucose inducible (SEQ ID NO: 86), pICL1—glucose inducible (SEQ ID NO: 87), pADH2—glucose inducible (SEQ ID NO: 88), and pMLS1—glucose inducible (SEQ ID NO: 89).

In some aspects, the inducible promoter(s) may be selected from the group consisting of pCTR1, pCTR3, pCUR1, pCUR2, pCUR3, pCUR4, pCUR5p, pCUR6, pCUR7, pCUR8, pCUR9, pCUR10, pCUR11, pCUR12, pCUR13, pCUR14, pCUR15, pCUR16, pCUR17, pLYS1, pLYS4, pLYS9, pLYR1p, pLYR2p, pLYR3p, pLYR4p, pLYR5p, pLYR6p, pLYR7p, pLYR8, pLYR9, pLYR10, pLYR11, pMET17, pMET6, pMET14, pMET3, pSAM1, pSAM2, pMDH2, pJEN1, pICL1, pADH2, and pMLS1.

In some aspects, inducible promoters may be selected from the group comprising promoters inducible with copper, promoters inducible due to the absence of copper, promoters inducible due to the absence of glucose, promoters inducible due to the absence of lysine, promoters inducible with methionine, promoters inducible due to the absence of methionine, and promoters inducible with threonine.

In some aspects, inducible promoter may be selected from the group consisting of pSAM4, pCUP1-1, pCUP1.Cgla, pCUP1.Sba, pACU1, pACU2, pACU3p, pACU4p, pACU5, pACU6, pACU7, pACU8, pACU9, pACU10p, pACU11, pACU12, pACU13, pACU14, pACU15, pGAL/CUP1p, pCRS5, pCHA1, pCTR1, pCTR3, pCUR1, pCUR2, pCUR3, pCUR4, pCUR5p, pCUR6, pCUR7, pCUR8, pCUR9, pCUR10, pCUR11, pCUR12, pCUR13, pCUR14, pCUR15, pCUR16, pCUR17, pLYS1, pLYS4, pLYS9, pLYR1p, pLYR2p, pLYR3p, pLYR4p, pLYR5p, pLYR6p, pLYR7p, pLYR8, pLYR9, pLYR10, pLYR11, pMET17, pMET6, pMET14, pMET3, pSAM1, pSAM2, pMDH2, pJEN1, pICL1, pADH2 and pMLS1.

In some aspects, the inducible promoters, identical or different, may be preferably characterized by a sequence of nucleic acids selected from the group consisting of sequences having at least 80/85/90/95/96/97/98/99/100% identity with sequences SEQ ID NOs: 13-89.

In some aspects, synthetic promoters, as described in Blazeck & Alper (2013) Biotechnol. J. 8 46-58, can also be used.

The strong and inducible or repressible promoters of the disclosure can originate from any organism from Saccharomycetes class and can in particular originate, independently, from an organism selected from the group consisting of *Saccharomyces cerevisiae, Saccharomyces boulardii, Saccharomyces castelii, Saccharomyces bayanus, Saccharomyces arboricola, Saccharomyces kudriavzevii, Ashbya gossypii, Kluveromyces lactis, Pichia pastoris, Candida glabrata, Candida tropicalis, Debaryomyces castelii, Yarrowia hpolitica*, and *Cyberlindnera jadinii*.

In some aspects, strong, weak, and inducible promoters may originate from an organism selected from the group consisting of *Saccharomyces cerevisiae, Saccharomyces castelii, Saccharomyces bayanus, Saccharomyces arboricola, Saccharomyces kudriavzevii*, and *Kluveromyces lactis*.

Terminators

In some aspects, the recombinant microbes comprise appropriate transcription terminator sequences that are functional in yeast cells, including in *Saccharomyces cerevisiae*. In some aspects, the transcription terminators, identical or different, may be found in Yamanishi et al., (2013) ACS synthetic biology 2, 337-347.

In some aspects, terminators may be selected from the group comprising:
tTDH2 from the gene coding for Glyceraldehyde-3-phosphate dehydrogenase, isozyme 2 (TDH2 gene=Sequence SEQ ID NO: 90),
tCYC1 (=Sequence SEQ ID NO: 91),
tTDH3 (=Sequence SEQ ID NO: 92),
tADH1 from gene coding for the alcohol dehydrogenase (ADH1 gene=Sequence SEQ ID NO: 93),
tADH2 from gene coding for the alcohol dehydrogenase (ADH2 gene=Sequence SEQ ID NO: 94),
tTPI1 from the gene encoding for the Triose Phosphate Isomerase (TPI1 gene=Sequence SEQ ID NO: 95),
tMET17 from the gene encoding for the O-acetyl homoserine-O-acetyl serine sulfhydrylase (Met17 gene=Sequence SEQ ID NO: 96),
tENO2 from the gene coding for Enolase II (ENO2 gene=Sequence SEQ ID NO: 97),
tMET3 (=Sequence SEQ ID NO: 98),
tPGK1 from the gene encoding for the 3-phosphoglycerate kinase (PGK1 gene=Sequence SEQ ID NO: 99),
tDIT1 (=Sequence SEQ ID NO: 100)
tRPL3 (=Sequence SEQ ID NO: 101)
tRPL41B (=Sequence SEQ ID NO: 102)
tRPL15A (=Sequence SEQ ID NO: 103)
tIDP1 (=Sequence SEQ ID NO: 104)

In some aspects, the terminator, identical or different, may be preferably characterized by a sequence of nucleic acid selected from the group consisting of sequences having at least 80/85/90/95/96/97/98/99/100% identity with SEQ ID NOs: 90-104.

Malonate Semialdehyde, Salts Thereof and Derivatives Thereof

Malonate semialdehyde and its salts thereof are a key intermediate for the production of valuable compounds. These compounds of economic interest include those produced directly from malonate semialdehyde or its salts, such as acrylate, 1-propanol, isopropanol, 3-hydroxypropionate, and propionate, but also those derived from malonyl-CoA, mostly produced by polyketides synthases such as phloroglucinol and flavonoids, and the fatty acids synthase, or those derived from the mevalonate such as farnesyl-PP, squalene and derivatives or the 3-hydroxy-3-methyl-butyrate pathways.

Malonate semialdehyde and its salts are naturally produced in yeast from malonyl-CoA and beta-alanine. However, production of malonyl-CoA and its salts is in competition with the ethanol biosynthesis pathway, thus rendering difficult the flux derivation to malonate semialdehyde.

Moreover, production from beta-alanine requires the amination of oxaloacetate followed by the deamination of beta-alanine, involving a great number of enzymes.

In order to facilitate the production of malonate semialdehyde and its salts in yeasts, it has been proposed to obtain malonate semialdehyde in one step by decarboxylation of oxaloacetate (US2010/0021978). However, no natural enzyme is known as being able to perform this transformation in a natural pathway efficiently. The enzymatic activity of the decarboxylation of oxaloacetate into malonate semialdehyde is herein referred to as oxaloacetate 1-decarboxylase (MSA forming), and is not to be confused with oxaloacetate decarboxylase (EC 4.1.1.3) which yields pyruvate.

US2010/0021978 proposes the use of a promiscuous decarboxylase such as the benzoylformate decarboxylase, the alpha-ketoglutarate decarboxylase, the alpha-ketoisovalerate decarboxylase or the pyruvate decarboxylase to perform this decarboxylation of oxaloacetate in malonate semialdehyde or one of its salts. This document exemplifies the use of benzoylformate decarboxylase in *Escherichia coli* to produce 3 hydroxypropionate through malonate semialdehyde.

US2018/032830 proposes and exemplifies the use of a decarboxylase such as pyruvate decarboxylase to perform this decarboxylation of oxaloacetate in 3-oxopropanoate (malonate semialdehyde) to produce 3-hydroxipropionate.

U.S. Pat. No. 8,809,027 proposes and exemplifies the use of pyruvate decarboxylase, 2-oxoglutarate decarboxylase and alpha-ketoglutarate decarboxylase to perform the decarboxylation of oxaloacetate in malonate semialdehyde to produce 3-hydroxipropionate.

The inventors in the aforementioned pre-grant publication could detect carboxylase activity both in cellulo and in vitro on their cognate substrate, the inventors were unable to detect any activity of all these enzymes on oxaloacetate.

Accordingly, there is still a need in the art for enzymes able to efficiently catalyze the transformation of oxaloacetate into malonate semialdehyde, or one of its salts, when expressed in a yeast, and in particular in the yeast *Saccharomyces cerevisiae*.

Malonate semialdehyde is a compound having the following structure:

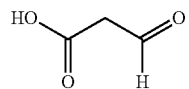

In some aspects, the compound may exist in the form of a base or of a salt. In some aspects, the salt can be malonate semialdehyde having the following structure:

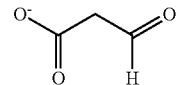

In some aspects, organic cation salts such as ammonium, sodium, potassium, phosphonium, or sulfonium salts may also be concerned.

In some aspects, malonate semialdehyde derivatives are compounds that may be obtained from malonate semialdehyde, or from one of its salts, after modification by at least one enzyme naturally or artificially present in the microorganism producing the malonate semialdehyde, or one of its salts.

In some aspects, derivatives of malonate semialdehyde include propanol, propanal, acrylic acid, acrylyl-CoA, acetyl-CoA, 3-HP, acrylate, acetone, isopropanol, propionate, propionyl-CoA, 3-hydroxypropionate, 3-hydroxypropionyl-CoA, 3-hydroxy-3-methyl-butyrate, phloroglucinol, flavonoids, cannabinoids, farnesyl-PP, and squalene.

Figure 11:
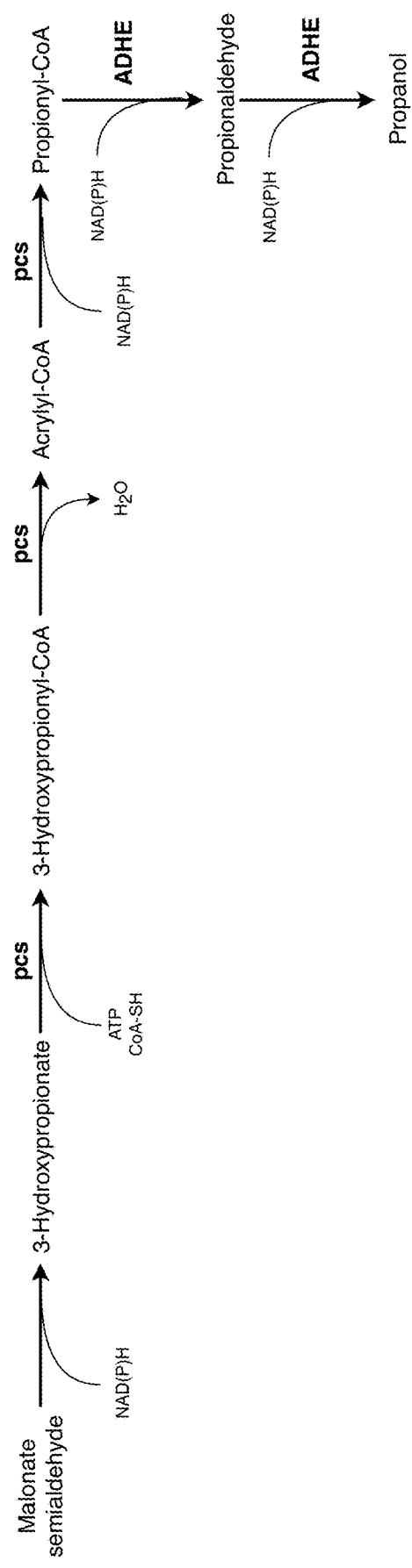
FIG. 11 depicts a pathway from malonate semialdehyde to propanol, including catalytic enzymes and corresponding malonate semialdehyde intermediates.

In some aspects, 3-hydroxypropionate, Acrylyl-CoA, Propionyl-CoA, propanal and propanol can be obtained from malonate semialdehyde or from one of its salts through the steps detailed in FIG. 11 PCS represents a propionyl-CoA synthase, such as the PCS of *Chloroflexus aggregans*, *Roseiflexus castenholzii*, or *Chloroflexus aurantiacus*. This reaction can be catalyzed by enzymes with, but not restricted to, EC number 6.2.1.17/6.2.1.36 such as listed in Table 3. ADHE represents an alcohol dehydrogenase E, such as the ADHE from *Clostridium beijerinckii* or *Clostridium arbusti*. This reaction can be catalyzed by enzymes with, but not restricted to, EC number 1.1.1.1/1.2.1.4/1.2.1.5 such as those listed in Table 7.

Figure 12:
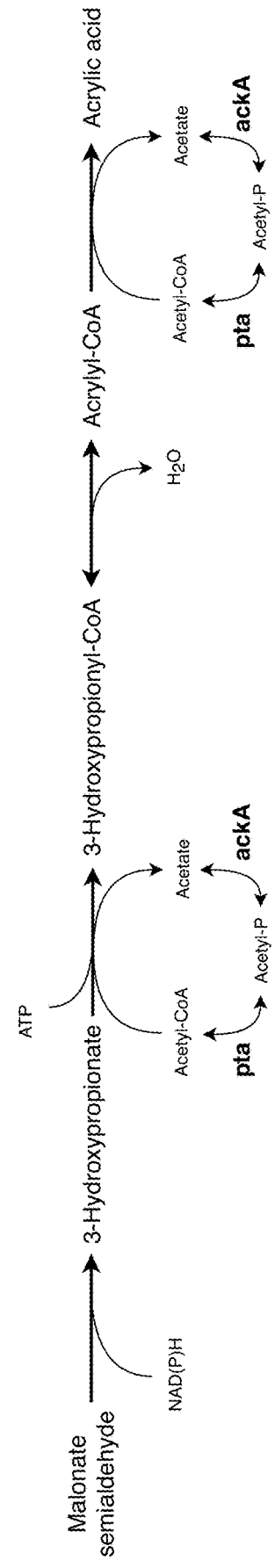
FIG. 12 depicts a pathway from malonate semialdehyde to acrylic acid, including malonate semialdehyde intermediates and corresponding cofactors.

In some aspects, acrylic acid and acrylate can be obtained from malonate semialdehyde or from one of its salts by multi-step enzymatic reactions involving the CoA attachment to 3-HP, dehydration of 3-HP-CoA to acrylyl-CoA as depicted in FIG. 12 and detachment of CoA from acrylyl-CoA as a synthetic pathway already demonstrated in the literature (Chu et al. Direct fermentation route for the production of acrylic acid. Metabolic Engineering, 32 (2015), 23-29). The steps from malonate semialdehyde to acrylyl-CoA can be catalyzed by 3-hydroxypropionic acid dehydrogenase with, but not restricted to, EC number 1.1.1.381 such as those listed in Table 1; 3-hydroxypropionyl-CoA synthetase/CoA transferases that can be used have, but are not restricted to, EC numbers 2.8.3.1/6.2.1.17/6.2.1.36 such as those listed in Table 4; 3-hydroxypropionyl-CoA dehydratase/enoyl-CoA hydratases that can be used have, but are not restricted to, EC numbers 4.2.1.116/4.2.1.55/4.2.1.150/4.2.1.17 such as those listed in Table 5 and acyl-CoA hydrolase or thioesterase (Table 14). Acrylic acid can be derived chemically via a dehydration reaction. Dehydration methods of 3-hydroxypropionic acid are well known in the art. For example, incorporated herein for its teachings of conversion of 3-HP, U.S. Pat. No. 8,846,353 B2 describes a method where 3-HP present in a fermentation broth can be dehydrated in a vapor phase reaction in the presence of an acid catalyst like but not limited to NaH2PO4-silica gel, H3PO4-silica gel, CuSO4-silica gel and zeolite H-β-H3PO4. The U.S. Pat. No. 2,469,701 describes other example for the reaction by adding 3-hydroxypropionic acid gradually to a concentrated dehydration catalyst, such as phosphoric acid or sulfuric acid maintained at a temperature of about 150-190° C. under reduced pressure, in the presence of powdered metallic copper and separating the aqueous acrylic acid formed from the catalyst by distillation. An aqueous phase containing 3-HP can also be dehydrated via reactive distillation to give a fluid acrylic acid solution that may proceed to an optional purification step by a suspension crystallization or a layer crystallization as described in U.S. Pat. No. 8,198,481 B2.

Figure 9:
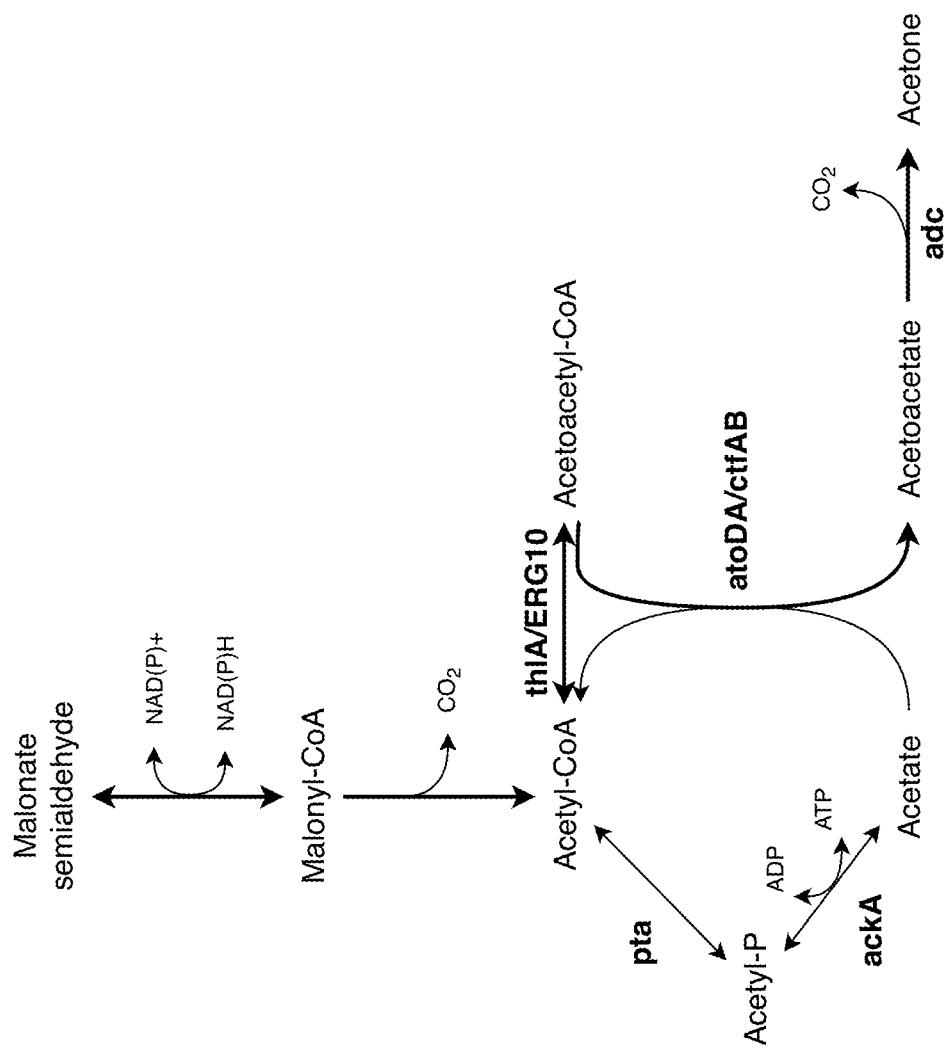
FIG. 9 depicts a pathway from malonate semialdehyde to acetone, including catalytic enzymes and corresponding malonate semialdehyde intermediates.
Figure 10:
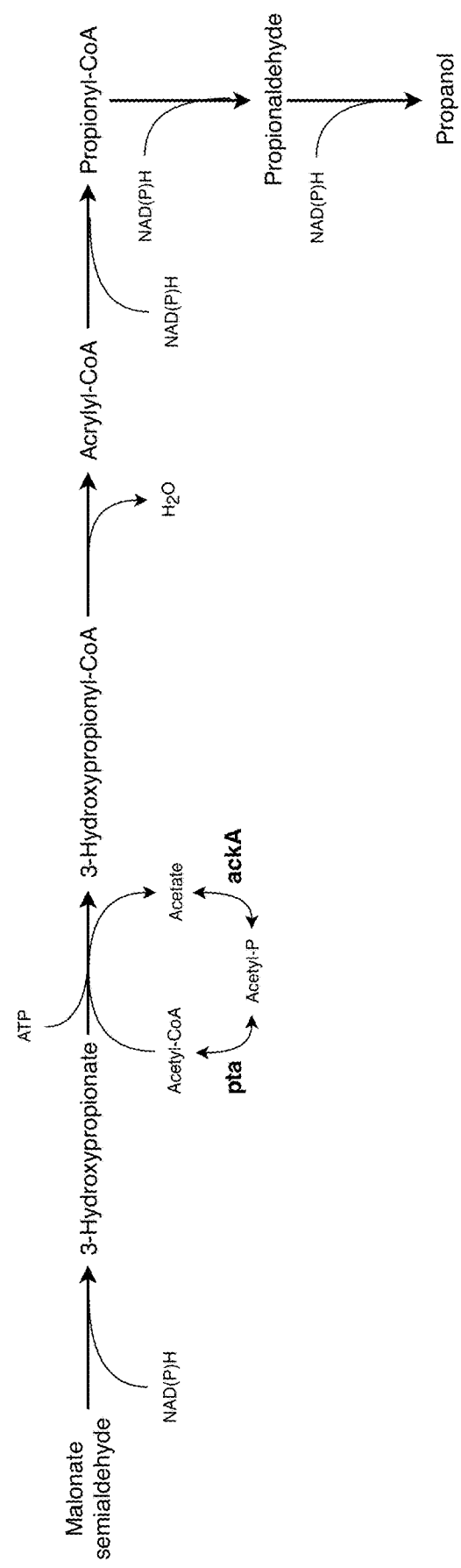
FIG. 10 depicts a pathway from malonate semialdehyde to propanol, including malonate semialdehyde intermediates and corresponding cofactors.

In some aspects, malonate semialdehyde can be transformed into acetyl-CoA by a malonate semiadehyde dehydrogenase (acetylating (E.C. 1.2.1.18), such as KES23460 from *Pseudonymous putida* described in Wilding et al. (2016. Appl. Microbiol Biotechnol, 82:3846-3856). See FIG. 9 Acetyl-CoA is then a starting point to produce isopropanol as described in Tamakawa et al. Appl Microbiol Biotechnol (2013) 97:6231-6239.

In some aspects, propionyl-CoA is obtained from malonate semialdehyde. Propionyl-CoA can then be transformed into propionate through the successive catalysis of phosphotransacetylase (E.C. 2.3.1.) and an acetate kinase (E.C. 2.7.2.1), described in Erbilgin et al. (2016) PLoS Biol 14(3): e1002399.doi:10.1371/journal.pbio.1002399 and Reinscheid et al. (1999) Microbiology 145, 503-513

Figure 4:
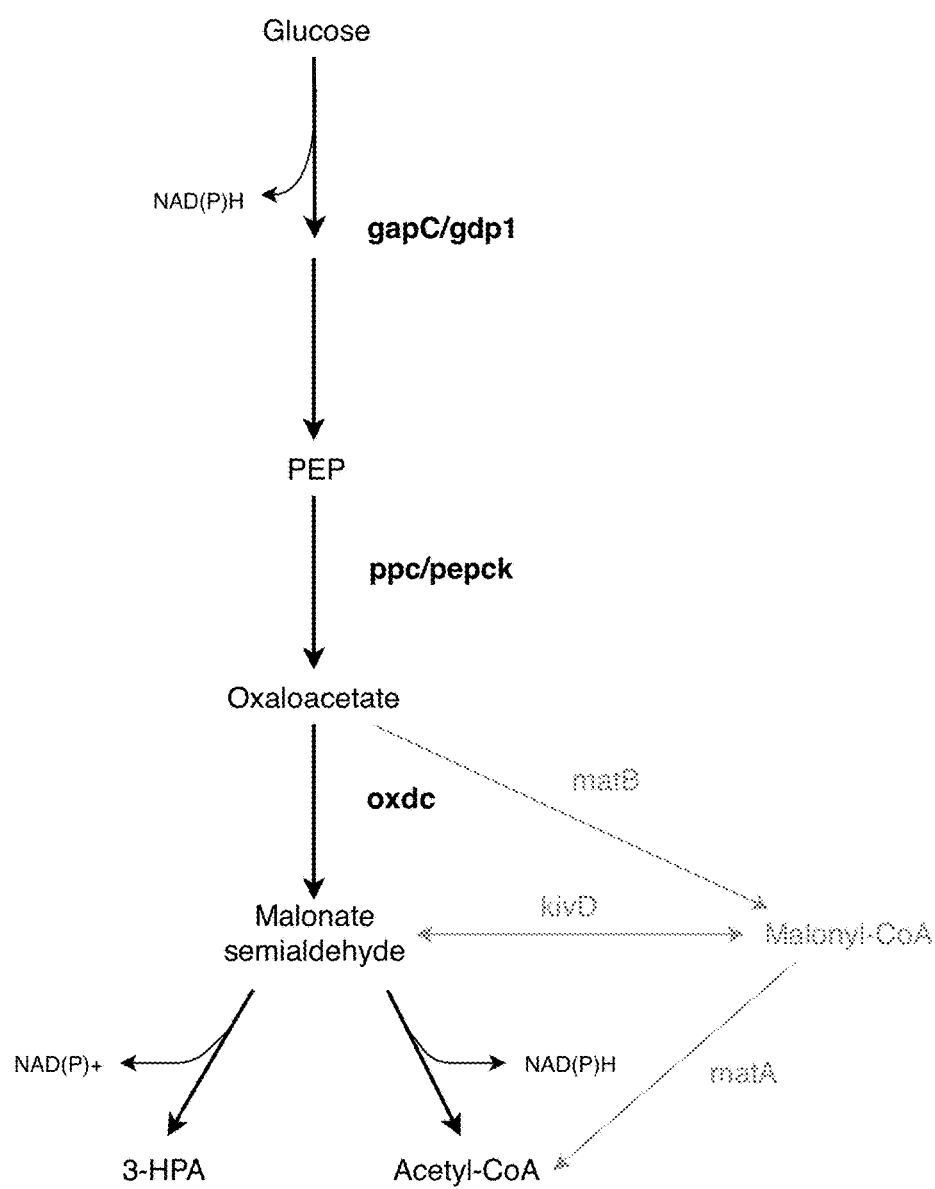
FIG. 4 depicts the two pathways for the production of acetyl-CoA, through malonyl-CoA as an intermediate (standard route) and directly with malonate semialdehyde (new route).

In some aspects, malonate semialdehyde can be transformed into malonyl-CoA by a malonyl-CoA reductase (E.C 1.2.1.75) as described in Alber et al. (2006) Journal of bacteriology 188, 8551-8559. See FIG. 4 Malonyl-CoA is then the starting point to synthetize phloroglucinol and derivatives using a phloroglucinol synthase (E.C.2.3.1.253) as described in Yang and Cao (2012) Appl Microbiol Biotechnol 93:487-495.

Malonyl-CoA is a major building block and often a bottleneck required for flavonoids biosynthesis (Johnson et al. (2017) Metabolic Engineering 44: 253-264). Malonate semialdehyde can be transformed into malonyl-CoA by a malonyl-CoA reductase (E.C 1.2.1.75) as described in Alber et al. (2006) Journal of bacteriology 188, 8551-8559. Malonyl-CoA can then be used to fuel flavonoids synthesis as described in Batra, Priya, and Anil K. Sharma. (2013) 3 Biotech 6: 439-59; and in Mou, et al. (2015) PLoS ONE 10(6).

Acetyl-CoA is also a major building block and often a bottleneck required for farnesyl-PP and derivatives biosynthesis, as for example squalene. As mentioned above, malonate semialdehyde can be transformed into acetyl-CoA by a malonate semialdehyde dehydrogenase (acetylating) (E.C 1.2.1.18) as for example KES23460 from *Pseudomonas putida* described in Wilding et al. (2016) Appl. Env. Microbiology, 82, 3846-3856. Acetyl-CoA is then a starting point to produce Farnesyl PP and derivatives as described in Wang, J.; Li, Y.; Liu, D. Cloning and Characterization of Farnesyl Diphosphate Synthase Gene Involved in Triterpenoids Biosynthesis from *Poria cocos*. Int. J. Mol. Sci. 2014, 15, 22188-22202.

In some aspects, cannabinoids can be obtained from malonate semialdehyde or from one of its salts from acetyl-CoA which is the precursor of all cannabinoids. Malonate semialdehyde can be transformed into acetyl-CoA by a malonate semialdehyde dehydrogenase (acetylating) (E.C 1.2.1.18) as for example KES23460 from *Pseudomonas putida* described in Wilding et al. Acetyl-CoA is then a starting point to produce cannabinoids as described in Carvalho et al. (2017) FEMS Yeast Research, 17, fox037. doi: 10.1093/femsyr/fox037.

In some aspects, 3-hydroxy-3-methyl-butyrate can be obtained from malonic semialdehyde or from one of its salts as follows. Malonate semialdehyde can, as mentioned above, be transformed into acetyl-CoA by a malonate semialdehyde dehydrogenase (acetylating) (E.C 1.2.1.18) as for example KES23460 from *Pseudomonas putida* described in Wilding et al. Acetyl-CoA is then the starting point for 3-hydroxy-3-methyl-butyrate biosynthesis as described in Gogerty and Bobic (2010) Appl Microbiol Biotechnol 76: 8004-8010.

In some aspects, a recombinant microbe of the present disclosure may comprise one or more nucleic acid sequences encoding the enzymes mentioned above in order to obtain the malonate semialdehyde and/or derivatives of interest. The one or more nucleic acid sequences encoding the enzymes performing the necessary transformations of malonate semialdehyde, or one of its salts, to the malonate semialdehyde derivative of interest can be naturally present in the microbe (endogenous) and/or can be incorporated into the microbe as transgenes according to methods well known to the man skilled in the art.

In some aspects, a recombinant microbe of the present disclosure may comprise, in addition to a nucleic acid sequence encoding an enzyme able to catalyze the decarboxylation of oxaloacetate into malonate semialdehyde as defined above, at least one nucleic acid encoding a 3-hydroxy acid dehydrogenase and/or a malonyl-CoA reductase.

In some aspects, the 3-hydroxy acid dehydrogenase and/or malonyl-CoA reductase according to this embodiment can be, but not limited to, the 3-hydroxy acid dehydrogenase with EC number 1.1.1.381 such as those listed in Table 1.

In some aspects, a recombinant microbe of the present disclosure may comprise, in addition to a nucleic acid gene encoding an enzyme able to catalyze the decarboxylation of oxaloacetate into malonate semialdehyde as defined above, (i) at least one nucleic acid encoding a 3-hydroxy acid dehydrogenase or a malonyl-CoA reductase and (ii) at least one nucleic acid encoding a propionyl-CoA synthase.

In some aspects, the 3-hydroxy acid dehydrogenase and/or malonyl-CoA reductase according to this embodiment can be, but not limited to, the 3-hydroxy acid dehydrogenase with EC number 1.1.1.381 such as those listed in Table 1. The propionyl-coA synthase (PCS) that can be used has, but is not restricted to, EC numbers 6.2.1.17/6.2.1.36 as those listed in Table 3.

In some aspects, a recombinant microbe of the disclosure may comprise, in addition to a nucleic acid gene encoding an enzyme able to catalyze the decarboxylation of oxaloacetate into malonate semialdehyde as defined above, (i) at least one nucleic acid encoding a 3-hydroxy acid dehydrogenase or a malonyl-CoA reductase, (ii) at least one nucleic acid encoding a propionyl-CoA synthase or 3-hydroxypropionyl-CoA synthetase/transferase, 3-hydroxypropionyl-CoA dehydratase, and acrylyl-CoA reductase and (iii) at least one alcohol dehydrogenase E or aldehyde dehydrogenase and alcohol dehydrogenase.

In some aspects, the 3-hydroxy acid dehydrogenase and/or malonyl-CoA reductase of the disclosure may be the 3-hydroxy acid dehydrogenase with, but not restricted to, EC number 1.1.1.381 such as those listed in Table 1. In some aspects, the propionyl-CoA synthase (PCS) of the disclosure may be the PCS with, but not limited to, EC numbers 6.2.1.17/6.2.10.36 such as those listed in Table 3.

In some aspects, the ADHE of the disclosure that can be used, but is not restricted to, is a enzyme with EC numbers 1.1.1.1/1.2.1.4/1.2.1.5 such as those listed in Table 7. In some aspects, it is possible to use two enzymes to convert propanol from propionyl-CoA. Can be used, but are not restricted to, enzymes with EC numbers 1.2.1.10/1.2.1.87 such as those listed in Table 8 or enzymes with EC numbers 2.3.1.8/2.7.2.1 such as those listed in Table 10 and enzymes with EC numbers 1.1.1.1/1.1.1.2 such as those listed in Table 9.

In some aspects, the recombinant microbe may comprise, in addition to a nucleic acid sequence encoding an enzyme able to catalyze the decarboxylation of oxaloacetate into malonate semialdehyde as defined above, (i) at least one nucleic acid encoding a 3-hydroxy acid dehydrogenase or a malonyl-CoA reductase and (ii) at least one nucleic acid encoding a propionate-CoA transferase.

In some aspects, a propionate-CoA transferase may be, but not restricted to, the enzyme with the reference E.C.2.8.3.1.

In some aspects, the 3-hydroxy acid dehydrogenase and/or malonyl-CoA reductase may be, but not limited to, the 3-hydroxy acid dehydrogenase or the malonyl-CoA reductase with EC number 1.1.1.381 such as those listed in Table 1. In some aspects, the propionate-CoA transferase may be, but not limited to, the propionate-CoA transferases or 3-hydroxypropionyl-CoA synthetases with EC number 2.8.3.1/6.2.1.17/6.2.1.36 such as those listed in Table 4.

In some aspects, a recombinant microbe may comprise, in addition to a nucleic acid gene encoding an enzyme able to catalyze the decarboxylation of oxaloacetate into malonate semialdehyde as defined above, (i) at least one nucleic acid encoding a 3-hydroxy acid dehydrogenase or a malonyl-CoA reductase, (ii) at least one nucleic acid encoding a propionate-CoA transferase and (iii) at least one 3-hydroxypropionyl coenzyme A dehydratase.

In some aspects, the 3-hydroxy acid dehydrogenase and/or malonyl-CoA reductase may be, but are not restricted to enzymes with EC number 1.1.1.381 such as those listed in Table 1. In some aspects, the propionate-CoA transferase or 3-hydroxypropionyl-CoA synthetase that can be used has, but is not restricted to, EC number 2.8.3.1/6.2.1.17/6.2.1.36 such as those listed in Table 4. In some aspects, the 3-hydroxypropionyl coenzyme A dehydratase may be, but is not restricted to enzymes with EC numbers 4.2.1.116/4.2.1.55/4.2.1.150/4.2.1.17 such as those listed in Table 5.

In some aspects, the disclosure is drawn to a recombinant microbial organism, a microbe in some aspects, able to catalyze the decarboxylation of oxaloacetate into malonate semialdehyde. In some aspects, these enzymes are characterized by SEQ ID NO: 1, as follows.

(SEQ ID NO: 1)
MASVHGTTYELLRRQGIDTVFGNPGSNELPFLKDFPEDFRYILALQEACV

VGIADGYAQASRKPAFINLHSAAGTGNAMGALSNAWNSHSPLIVTAGQQT

RAMIGVEAX$_1$X$_2$TNVDAANLPRPLVKWSYEPASAAEVPHAMSRAIHMASM

APQGPVYLSVPYDDWDKDADPQSHHLFDRHVSSSVRLNDQDLDILVKALN

SASNPAIVLGPDVDAANANADCVMLAERLKAPVWVAPSAPRCPFPTRHPC

FRGLMPAGIAAISQLLEGHDVVLVIGAPVFRYHQYDPGQYLKPGTRLISV

TCDPLEAARAPMGDAIVADIGAMASALANLVEESSRQLPTAAPEPAKVDQ

DAGRLHPETVFDTLNDMAPENAIYLNESX$_3$STTAQMWQRLNMRNPGSYY

X$_4$X$_5$AAGGX$_6$GFALPAAIGVQLAEPERQVIAVIGDSANYSISALWTAAQY

NIPTIFVIMNNGTYGX$_7$LRWFAGVLEAENVPGLDVPGIDFRALAKGYGVQ

ALKADNLEQLKGSLQEALSAKGPVLIEVSTVSPVK;

wherein:

X$_1$ represents an amino acid selected from the group consisting of leucine, lysine, arginine and valine;

X$_2$ represents an amino acid selected from the group consisting of leucine and lysine;

X$_3$ represents an amino acid selected from the group consisting of threonine and serine; X$_4$ represents an amino acid selected from the group consisting of phenylalanine, asparagine, alanine, isoleucine and valine;

X$_5$ represents an amino acid selected from the group consisting of cysteine and arginine; X$_6$ represents an amino acid selected from the group consisting of leucine, asparagine and alanine; and X$_7$ represents an amino acid selected from the group consisting of alanine and leucine, with the proviso that the enzyme cannot have the sequence SEQ ID NO: 1 wherein X$_1$ represents leucine; X$_2$ represents leucine; X$_3$ represents threonine; X$_4$ represents phenylalanine; X$_5$ represents cysteine; X$_6$ represents leucine; and X$_7$ represents alanine.

In some aspects, X$_1$ represents an amino acid selected from the group consisting of lysine, arginine and valine. In some aspects, X$_1$ represents an amino acid selected from the group consisting of arginine and valine. In some aspects, X$_1$ is arginine.

In some aspects, an enzyme of the disclosure is that of SEQ ID NO: 1 as defined above, with X$_1$ being arginine.

In some aspects, X$_2$ represents leucine.

In some aspects, X$_1$ represents valine and X$_2$ represents lysine.

In some aspects, X$_3$ represents threonine.

In some aspects, X$_1$ is arginine, X$_2$ represents leucine and X$_3$ represents threonine.

In some aspects, X$_4$ represents phenylalanine or asparagine.

In some aspects, an enzyme of sequence of SEQ ID NO: 1 is such that:

X$_1$ is arginine or lysine, X$_2$ represents leucine, X$_3$ represents threonine and X$_4$ represents phenylalanine; or X$_1$ is arginine or lysine, X$_2$ represents leucine, X$_3$ represents threonine and X$_4$ represents asparagine.

In some aspects, X$_5$ represents cysteine.

In some aspects, an enzyme of sequence SEQ ID NO: 1 is such that:

X$_1$ is arginine or lysine, X$_2$ represents leucine, X$_3$ represents threonine, X$_4$ represents phenylalanine and X$_5$ represents cysteine; or X$_1$ is arginine or lysine, X$_2$ represents leucine, X$_3$ represents threonine, X$_4$ represents asparagine, and X$_5$ represents cysteine.

In some aspects, X$_6$ represents an amino acid selected from the group consisting of leucine and asparagine. In some aspects, X$_6$ is leucine.

In some aspects, X$_1$ represents valine, X$_2$ represents lysine and X$_6$ represents asparagine.

In some aspects, an enzyme of sequence SEQ ID NO: 1 is such that:

X$_1$ is arginine or lysine, X$_2$ represents leucine, X$_3$ represents threonine, X$_4$ represents phenylalanine, X$_5$ represents cysteine and X$_6$ is leucine; or X$_1$ is arginine or lysine, X$_2$ represents leucine, X$_3$ represents threonine, X$_4$ represents asparagine, X$_5$ represents cysteine and X$_6$ is leucine.

In some aspects, X$_7$ represents alanine.

In some aspects, an enzyme of sequence SEQ ID NO: 1 is such that:

$X_1$ is arginine or lysine, $X_2$ represents leucine, $X_3$ represents threonine, $X_4$ represents phenylalanine, $X_5$ represents cysteine, $X_6$ is leucine and $X_7$ is alanine; or $X_1$ is arginine or lysine, $X_2$ represents leucine, $X_3$ represents threonine, $X_4$ represents asparagine, $X_5$ represents cysteine, $X_6$ is leucine and $X_7$ is alanine.

In some aspects, an enzyme of the disclosure is selected from the group consisting of:

(i) an enzyme of sequence SEQ ID NO: 1 wherein $X_1$ represents arginine; $X_2$ represents leucine; $X_3$ represents threonine; $X_4$ represents phenylalanine; $X_5$ represents cysteine; $X_6$ represents leucine; and $X_7$ represents alanine; (i.e. an enzyme of amino acid sequence SEQ ID NO: 2)

(ii) an enzyme of sequence SEQ ID NO: 1 wherein $X_1$ represents arginine; $X_2$ represents leucine; $X_3$ represents threonine; $X_4$ represents asparagine; $X_5$ represents cysteine; $X_6$ represents leucine; and $X_7$ represents alanine; (i.e. an enzyme of amino acid sequence SEQ ID NO: 3)

(iii) an enzyme of sequence SEQ ID NO: 1 wherein $X_1$ represents arginine; $X_2$ represents leucine; $X_3$ represents threonine; $X_4$ represents asparagine; $X_5$ represents cysteine; $X_6$ represents leucine; and $X_7$ represents alanine; (i.e. an enzyme of amino acid sequence SEQ ID NO: 4)

(iv) an enzyme of sequence SEQ ID NO: 1 wherein $X_1$ represents arginine; $X_2$ represents leucine; $X_3$ represents threonine; $X_4$ represents asparagine; $X_5$ represents cysteine; $X_6$ represents leucine; and $X_7$ represents leucine; (i.e. an enzyme of amino acid sequence SEQ ID NO: 5), and (v) an enzyme of sequence SEQ ID NO: 1 wherein $X_1$ represents valine; $X_2$ represents lysine; $X_3$ represents threonine; $X_4$ represents asparagine; $X_5$ represents cysteine; $X_6$ represents asparagine; and $X_7$ represents alanine. (i.e. an enzyme of amino acid sequence SEQ ID NO: 6)

In some aspects, the disclosure is drawn to a recombinant microbial organism, a microbe in some aspects, able to catalyze the decarboxylation of oxaloacetate into malonate semialdehyde. In some aspects, these enzymes are characterized by an amino acid sequence comprising:

(SEQ ID NO: 274)
MASVHGTTYELLRRQGID$X_8$VFGNPGSNELPFLKDFPEDFRYILALQEAC

VVGIADGYAQASRKPAFINLHSAAGTGNAMGALSNAWNSHSPLIVTAGQQ

TRAMIGVEA$X_1X_2$TNVDAANLPRPLVKWSYEPASAAEVPHAMSRAIHMAS

MAPQGPVYLSVPYDDWDKDADPQSHHLFDRHV$X_9$SSVRLNDQDLDILVKA

LNSASNP$X_{10}$IVLGPDVDAANANADCVMLAERLKAPVWVAPSAPRCPFPT

RHPCFRGLMPAGIAAISQLLEGHDVVLVIGAPVFRY$X_{11}X_{12}$YDPGQYLK

PGTRLISVTCDPLEAARAPMGDAIVADIGAMASALANLVEESSRQLPTAA

PEPAKVDQDAGRLHPETVFDTLNDMAPE$X_{13}$AIYLNES$X_3$STTAQMWQRL $X_{14}$MRNPGSYY$X_4X_5$AAGG$X_6$GFALPAAIGVQLAEP$X_{15}$RQVIAVIGDGS

ANYSISALWTAAQYN$X_{16}$PTIFVIMNNGTYG$X_7$LRW$X_{17}$AGVL$X_{18}$AENV

PGLDVPGIDFRALAKGYGVQALKADNLEQLKGSLQEALSAKGPVLIEVST

VSPVK wherein:

$X_1$ represents an amino acid selected from the group consisting of leucine, lysine, arginine and valine;

$X_2$ represents an amino acid selected from the group consisting of leucine and lysine;

$X_3$ represents an amino acid selected from the group consisting of threonine and serine;

$X_4$ represents an amino acid selected from the group consisting of phenylalanine, asparagine, alanine, isoleucine, valine, leucine, tryptophan and arginine;

$X_5$ represents an amino acid selected from the group consisting of cysteine and arginine;

$X_6$ represents an amino acid selected from the group consisting of leucine, asparagine, alanine, valine and serine;

$X_7$ represents an amino acid selected from the group consisting of alanine, leucine, threonine, glycine and asparagine;

$X_8$ represents an amino acid selected from the group consisting of threonine or isoleucine;

$X_9$ represents an amino acid selected from the group consisting of serine or threonine;

$X_{10}$ represents an amino acid selected from the group consisting of alanine or valine;

$X_{11}$ represents an amino acid selected from the group consisting of histidine or arginine;

$X_{12}$ represents an amino acid selected from the group consisting of glutamine or arginine;

$X_{13}$ represents an amino acid selected from the group consisting of asparagine or aspartic acid;

$X_{14}$ represents an amino acid selected from the group consisting of asparagine or aspartic acid;

$X_{15}$ represents an amino acid selected from the group consisting of glutamic acid or glycine;

$X_{16}$ represents an amino acid selected from the group consisting of isoleucine or valine;

$X_{17}$ represents an amino acid selected from the group consisting of phenylalanine or serine; and $X_{18}$ represents an amino acid selected from the group consisting of glutamic acid or glycine;

with the proviso that the enzyme cannot have the sequence SEQ ID NO: 274 wherein $X_1$ represents leucine; $X_2$ represents leucine; $X_3$ represents threonine; $X_4$ represents phenylalanine; $X_5$ represents cysteine; $X_6$ represents leucine; $X_7$ represents alanine, $X_8$ represents threonine; $X_9$ represents serine; $X_{10}$ represents alanine; $X_{11}$ represents histidine; $X_{12}$ represents glutamine; $X_{13}$ represents asparagine; $X_{14}$ represents asparagine; $X_{15}$ represents glutamic acid; $X_{16}$ represents isoleucine; $X_{17}$ represents phenylalanine and $X_{18}$ represents glutamic acid.

An enzyme according to the invention can in particular be selected from the group consisting of:

(i) an enzyme of sequence SEQ ID NO: 274 wherein $X_1$ represents arginine; $X_2$ represents leucine; $X_3$ represents threonine; $X_4$ represents phenylalanine; $X_8$ represents cysteine; $X_6$ represents leucine; $X_7$ represents alanine; $X_8$ represents threonine; $X_9$ represents serine; $X_{10}$ represents alanine; $X_{11}$ represents histidine; $X_{12}$ represents glutamine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 2);

(ii) an enzyme of sequence SEQ ID NO: 274 wherein $X_1$ represents arginine; $X_2$ represents leucine; $X_3$ represents threonine; $X_4$ represents leucine; $X_8$ represents cysteine; $X_6$ represents leucine; $X_7$ represents threonine; $X_8$ represents threonine; $X_9$ represents serine; $X_{10}$ represents alanine; $X_{11}$ represents histidine; $X_{12}$ represents arginine; $X_{13}$ represents aspartic acid; $X_{14}$ represents asparagine; $X_{15}$ represents glutamic acid; $X_{16}$ represents valine; $X_{17}$ represents phenylalanine; and $X_{18}$ represents glutamic acid (i.e. an enzyme of amino acid sequence SEQ ID NO: 242);

(iii) an enzyme of sequence SEQ ID NO: 274 wherein $X_1$ represents arginine; $X_2$ represents leucine; $X_3$ represents threonine; $X_4$ represents phenylalanine; $X_5$ represents cysteine; $X_6$ represents leucine; $X_7$ represents leucine; $X_8$ represents isoleucine; $X_9$ represents serine; $X_{10}$ represents alanine; $X_{11}$ represents arginine; $X_{12}$ represents glutamine; $X_{13}$ represents asparagine; $X_{14}$ represents aspartic acid; $X_{15}$ represents glycine; $X_{16}$ represents isoleucine; $X_{17}$ represents serine; and $X_{18}$ represents glycine (i.e. an enzyme of amino acid sequence SEQ ID NO: 243);

(iv) an enzyme of sequence SEQ ID NO: 274 wherein $X_1$ represents arginine; $X_2$ represents leucine; $X_3$ represents threonine; $X_4$ represents phenylalanine; $X_5$ represents cysteine; $X_6$ represents leucine; $X_7$ represents glycine; $X_8$ represents threonine; $X_9$ represents serine; $X_{10}$ represents alanine; $X_{11}$ represents arginine; $X_{12}$ represents glutamine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 244);

(v) an enzyme of sequence SEQ ID NO: 274 wherein $X_1$ represents arginine; $X_2$ represents leucine; $X_3$ represents threonine; $X_4$ represents phenylalanine; $X_5$ represents cysteine; $X_6$ represents leucine; $X_7$ represents threonine; $X_8$ represents threonine; $X_9$ represents serine; $X_{10}$ represents alanine; $X_{11}$ represents histidine; $X_{12}$ represents arginine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 245);

(vi) an enzyme of sequence SEQ ID NO: 274 wherein $X_1$ represents arginine; $X_2$ represents leucine; $X_3$ represents threonine; $X_4$ represents phenylalanine; $X_5$ represents cysteine; $X_6$ represents leucine; $X_7$ represents leucine; $X_8$ represents threonine; $X_9$ represents serine; $X_{10}$ represents alanine; $X_{11}$ represents histidine; $X_{12}$ represents glutamine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 247);

(vii) an enzyme of sequence SEQ ID NO: 274 wherein $X_1$ represents arginine; $X_2$ represents leucine; $X_3$ represents threonine; $X_4$ represents phenylalanine; $X_5$ represents cysteine; $X_6$ represents leucine; $X_7$ represents alanine; $X_8$ represents threonine; $X_9$ represents serine; $X_{10}$ represents alanine; $X_{11}$ represents arginine; $X_{12}$ represents glutamine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 248);

(viii) an enzyme of sequence SEQ ID NO: 274 wherein $X_1$ represents arginine; $X_2$ represents leucine; $X_3$ represents threonine; $X_4$ represents phenylalanine; $X_5$ represents cysteine; $X_6$ represents leucine; $X_7$ represents threonine; $X_8$ represents threonine; $X_9$ represents serine; $X_{10}$ represents alanine; $X_{11}$ represents arginine; $X_{12}$ represents glutamine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 249);

(ix) an enzyme of sequence SEQ ID NO: 274 wherein $X_1$ represents arginine; $X_2$ represents leucine; $X_3$ represents threonine; $X_4$ represents phenylalanine; $X_5$ represents cysteine; $X_6$ represents leucine; $X_7$ represents alanine; $X_8$ represents threonine; $X_9$ represents serine; $X_{10}$ represents alanine; $X_{11}$ represents histidine; $X_{12}$ represents arginine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 250);

(x) an enzyme of sequence SEQ ID NO: 274 wherein $X_1$ represents arginine; $X_2$ represents leucine; $X_3$ represents threonine; $X_4$ represents phenylalanine; $X_5$ represents cysteine; $X_6$ represents leucine; $X_7$ represents leucine; $X_8$ represents threonine; $X_9$ represents serine; $X_{10}$ represents alanine; $X_{11}$ represents histidine; $X_{12}$ represents arginine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 251);

(xi) an enzyme of sequence SEQ ID NO: 274 wherein $X_1$ represents arginine; $X_2$ represents leucine; $X_3$ represents threonine; $X_4$ represents leucine; $X_5$ represents cysteine; $X_6$ represents leucine; $X_7$ represents leucine; $X_8$ represents threonine; $X_9$ represents serine; $X_{10}$ represents alanine; $X_{11}$ represents histidine; $X_{12}$ represents arginine; $X_{13}$ represents aspartic acid; $X_{14}$ represents asparagine; $X_{15}$ represents glutamic acid; $X_{16}$ represents valine; $X_{17}$ represents phenylalanine; and $X_{18}$ represents glutamic acid (i.e. an enzyme of amino acid sequence SEQ ID NO: 252);

(xii) an enzyme of sequence SEQ ID NO: 274 wherein $X_1$ represents arginine; $X_2$ represents leucine; $X_3$ represents threonine; $X_4$ represents leucine; $X_5$ represents cysteine; $X_6$ represents leucine; $X_7$ represents glycine; $X_8$ represents threonine; $X_9$ represents serine; $X_{10}$ represents alanine; $X_{11}$ represents histidine; $X_{12}$ represents arginine; $X_{13}$ represents aspartic acid; $X_{14}$ represents asparagine; $X_{15}$ represents glutamic acid; $X_{16}$ represents valine; $X_{17}$ represents phenylalanine; and $X_{18}$ represents glutamic acid (i.e. an enzyme of amino acid sequence SEQ ID NO: 253);

(xiii) an enzyme of sequence SEQ ID NO: 274 wherein $X_1$ represents arginine; $X_2$ represents leucine; $X_3$ represents threonine; $X_4$ represents leucine; $X_5$ represents cysteine; $X_6$ represents leucine; $X_7$ represents threonine; $X_8$ represents threonine; $X_9$ represents serine; $X_{10}$ represents alanine; $X_{11}$ represents histidine; $X_{12}$ represents arginine; $X_{13}$ represents aspartic acid; $X_{14}$ represents asparagine; $X_{15}$ represents glutamic acid; $X_{16}$ represents valine; $X_{17}$ represents serine; and $X_{18}$ represents glutamic acid (i.e. an enzyme of amino acid sequence SEQ ID NO: 254);

(xiv) an enzyme of sequence SEQ ID NO: 274 wherein $X_1$ represents arginine; $X_2$ represents leucine; $X_3$ represents threonine; $X_4$ represents leucine; $X_5$ represents cysteine; $X_6$ represents leucine; $X_7$ represents threonine; $X_8$ represents threonine; $X_9$ represents serine; $X_{10}$ represents alanine; $X_{11}$ represents histidine; $X_{12}$ represents arginine; $X_{13}$ represents aspartic acid; $X_{14}$ represents asparagine; $X_{15}$ represents glycine; $X_{16}$ represents valine; $X_{17}$ represents serine; and $X_{18}$ represents glycine (i.e. an enzyme of amino acid sequence SEQ ID NO: 255);

(xv) an enzyme of sequence SEQ ID NO: 274 wherein $X_1$ represents arginine; $X_2$ represents leucine; $X_3$ represents threonine; $X_4$ represents leucine; $X_5$ represents cysteine; $X_6$ represents leucine; $X_7$ represents threonine; $X_8$ represents threonine; $X_9$ represents serine; $X_{10}$ represents alanine; $X_{11}$ represents histidine; $X_{12}$ represents arginine; $X_{13}$ represents aspartic acid; $X_{14}$ represents asparagine; $X_{15}$ represents glycine; $X_{16}$ represents isoleucine; $X_{17}$ represents serine; and $X_{18}$ represents glycine (i.e. an enzyme of amino acid sequence SEQ ID NO: 256);

(xvi) an enzyme of sequence SEQ ID NO: 274 wherein $X_1$ represents arginine; $X_2$ represents leucine; $X_3$ represents threonine; $X_4$ represents phenylalanine; $X_5$ represents cysteine; $X_6$ represents leucine; $X_7$ represents leucine; $X_8$ represents isoleucine; $X_9$ represents serine; $X_{10}$ represents alanine; $X_{11}$ represents histidine; $X_{12}$ represents arginine; $X_{13}$ represents asparagine; $X_{14}$ represents aspartic acid; $X_{15}$ represents glycine; $X_{16}$ represents isoleucine; $X_{17}$ represents serine; and $X_{18}$ represents glycine (i.e. an enzyme of amino acid sequence SEQ ID NO: 257);

(xvii) an enzyme of sequence SEQ ID NO: 274 wherein $X_1$ represents arginine; $X_2$ represents leucine; $X_3$ represents threonine; $X_4$ represents phenylalanine; $X_5$ represents cysteine; $X_6$ represents leucine; $X_7$ represents leucine; $X_8$ represents isoleucine; $X_9$ represents serine; $X_{10}$ represents alanine; $X_{11}$ represents histidine; $X_{12}$ represents arginine; $X_{13}$ represents asparagine; $X_{14}$ represents aspartic acid; $X_{15}$ represents glycine; $X_{16}$ represents isoleucine; $X_{17}$ represents serine; and $X_{18}$ represents glycine (i.e. an enzyme of amino acid sequence SEQ ID NO: 258);

(xviii) an enzyme of sequence SEQ ID NO: 274 wherein $X_1$ represents arginine; $X_2$ represents leucine; $X_3$ represents threonine; $X_4$ represents tryptophan; $X_5$ represents cysteine; $X_6$ represents leucine; $X_7$ represents alanine; $X_8$ represents threonine; $X_9$ represents serine; $X_{10}$ represents alanine; $X_{11}$ represents arginine; $X_{12}$ represents glutamine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 259);

(xix) an enzyme of sequence SEQ ID NO: 274 wherein $X_1$ represents arginine; $X_2$ represents leucine; $X_3$ represents threonine; $X_4$ represents arginine; $X_5$ represents cysteine; $X_6$ represents valine; $X_7$ represents alanine; $X_8$ represents threonine; $X_9$ represents serine; $X_{10}$ represents alanine; $X_{11}$ represents arginine; $X_{12}$ represents glutamine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 260);

(xx) an enzyme of sequence SEQ ID NO: 274 wherein $X_1$ represents arginine; $X_2$ represents leucine; $X_3$ represents threonine; $X_4$ represents tryptophan; $X_5$ represents cysteine; $X_6$ represents leucine; $X_7$ represents asparagine; $X_8$ represents isoleucine; $X_9$ represents serine; $X_{10}$ represents alanine; $X_{11}$ represents histidine; $X_{12}$ represents arginine; $X_{13}$ represents asparagine; $X_{14}$ represents aspartic acid; $X_{15}$ represents glycine; $X_{16}$ represents isoleucine; $X_{17}$ represents serine; and $X_{18}$ represents glycine (i.e. an enzyme of amino acid sequence SEQ ID NO: 261);

(xxi) an enzyme of sequence SEQ ID NO: 274 wherein $X_1$ represents arginine; $X_2$ represents leucine; $X_3$ represents threonine; $X_4$ represents phenylalanine; $X_5$ represents cysteine; $X_6$ represents leucine; $X_7$ represents threonine; $X_8$ represents threonine; $X_9$ represents threonine; $X_{10}$ represents valine; $X_{11}$ represents histidine; $X_{12}$ represents arginine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 262);

(xxii) an enzyme of sequence SEQ ID NO: 274 wherein $X_1$ represents arginine; $X_2$ represents leucine; $X_3$ represents threonine; $X_4$ represents alanine; $X_5$ represents cysteine; $X_6$ represents leucine; $X_7$ represents threonine; $X_8$ represents threonine; $X_9$ represents serine; $X_{10}$ represents alanine; $X_{11}$ represents histidine; $X_{12}$ represents arginine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 263);

(xxiii) an enzyme of sequence SEQ ID NO: 274 wherein $X_1$ represents arginine; $X_2$ represents leucine; $X_3$ represents threonine; $X_4$ represents leucine; $X_5$ represents cysteine; $X_6$ represents leucine; $X_7$ represents threonine; $X_8$ represents threonine; $X_9$ represents serine; $X_{10}$ represents alanine; $X_{11}$ represents histidine; $X_{12}$ represents arginine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 264);

(xxiv) an enzyme of sequence SEQ ID NO: 274 wherein $X_1$ represents arginine; $X_2$ represents leucine; $X_3$ represents threonine; $X_4$ represents arginine; $X_5$ represents cysteine; $X_6$ represents valine; $X_7$ represents alanine; $X_8$ represents threonine; $X_9$ represents serine; $X_{10}$ represents alanine; $X_{11}$ represents histidine; $X_{12}$ represents arginine; $X_{13}$ represents aspartic acid; $X_{14}$ represents asparagine; $X_{15}$ represents glutamic acid; $X_{16}$ represents valine; $X_{17}$ represents phenylalanine; and $X_{18}$ represents glutamic acid (i.e. an enzyme of amino acid sequence SEQ ID NO: 265);

(xxv) an enzyme of sequence SEQ ID NO: 274 wherein $X_1$ represents arginine; $X_2$ represents leucine; $X_3$ represents threonine; $X_4$ represents arginine; $X_5$ represents cysteine; $X_6$ represents valine; $X_7$ represents glycine; $X_8$ represents threonine; $X_9$ represents serine; $X_{10}$ represents alanine; $X_{11}$ represents histidine; $X_{12}$ represents arginine; $X_{13}$ represents aspartic acid; $X_{14}$ represents asparagine; $X_{15}$ represents glutamic acid; $X_{16}$ represents valine; $X_{17}$ represents phenylalanine; and $X_{18}$ represents glutamic acid (i.e. an enzyme of amino acid sequence SEQ ID NO: 266);

(xxvi) an enzyme of sequence SEQ ID NO: 274 wherein $X_1$ represents arginine; $X_2$ represents leucine; $X_3$ represents threonine; $X_4$ represents tryptophan; $X_5$ represents cysteine; $X_6$ represents serine; $X_7$ represents asparagine; $X_8$ represents threonine; $X_9$ represents serine; $X_{10}$ represents alanine; $X_{11}$ represents histidine; $X_{12}$ represents arginine; $X_{13}$ represents aspartic acid; $X_{14}$ represents asparagine; $X_{15}$ represents glutamic acid; $X_{16}$ represents valine; $X_{17}$ represents phenylalanine; and $X_{18}$ represents glutamic acid (i.e. an enzyme of amino acid sequence SEQ ID NO: 267);

(xxvii) an enzyme of sequence SEQ ID NO: 274 wherein $X_1$ represents arginine; $X_2$ represents leucine; $X_3$ represents threonine; $X_4$ represents tryptophan; $X_5$ represents cysteine; $X_6$ represents leucine; $X_7$ represents glycine; $X_8$ represents threonine; $X_9$ represents serine; $X_{10}$ represents alanine; $X_{11}$ represents arginine; $X_{12}$ represents glutamine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 268);

(xxviii) an enzyme of sequence SEQ ID NO: 274 wherein $X_1$ represents arginine; $X_2$ represents leucine; $X_3$ represents threonine; $X_4$ represents arginine; $X_5$ represents cysteine; $X_6$ represents leucine; $X_7$ represents glycine; $X_8$ represents threonine; $X_9$ represents serine; $X_{10}$ represents alanine; $X_{11}$ represents arginine; $X_{12}$ represents glutamine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 269);

(xxix) an enzyme of sequence SEQ ID NO: 274 wherein $X_1$ represents arginine; $X_2$ represents leucine; $X_3$ represents threonine; $X_4$ represents tryptophan; $X_5$ represents cysteine; $X_6$ represents leucine; $X_7$ represents threonine; $X_8$ represents threonine; $X_9$ represents serine; $X_{10}$ represents alanine; $X_{11}$ represents histidine; $X_{12}$ represents arginine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 270);

(xxx) an enzyme of sequence SEQ ID NO: 274 wherein $X_1$ represents arginine; $X_2$ represents leucine; $X_3$ represents threonine; $X_4$ represents arginine; $X_5$ represents cysteine; $X_6$ represents leucine; $X_7$ represents threonine; $X_8$ represents threonine; $X_9$ represents serine; $X_{10}$ represents alanine; $X_{11}$ represents histidine; $X_{12}$ represents arginine; $X_{13}$ represents asparagine; $X_{14}$ represents asparagine; $X_{15}$ represents glutamic acid; $X_{16}$ represents isoleucine; $X_{17}$ represents phenylalanine; and $X_{18}$ represents glutamic acid (i.e. an enzyme of amino acid sequence SEQ ID NO: 271);

(xxxi) an enzyme of sequence SEQ ID NO: 274 wherein $X_1$ represents arginine; $X_2$ represents leucine; $X_3$ represents threonine; $X_4$ represents arginine; $X_5$ represents cysteine; $X_6$ represents valine; $X_7$ represents threonine; $X_8$ represents threonine; $X_9$ represents serine; $X_{10}$ represents alanine; $X_{11}$ represents histidine; $X_{12}$ represents arginine; $X_{13}$ represents aspartic acid; $X_{14}$ represents asparagine; $X_{15}$ represents glutamic acid; $X_{16}$ represents valine; $X_{17}$ represents phenylalanine; and $X_{18}$ represents glutamic acid (i.e. an enzyme of amino acid sequence SEQ ID NO: 272); and (xxxii) an enzyme of sequence SEQ ID NO: 274 wherein $X_1$ represents arginine; $X_2$ represents leucine; $X_3$ represents threonine; $X_4$ represents tryptophan; $X_5$ represents cysteine; $X_6$ represents serine; $X_7$ represents threonine; $X_8$ represents threonine; $X_9$ represents serine; $X_{10}$ represents alanine; $X_{11}$ represents histidine; $X_{12}$ represents arginine; $X_{13}$ represents aspartic acid; $X_{14}$ represents asparagine; $X_{15}$ represents glutamic acid; $X_{16}$ represents valine; $X_{17}$ represents phenylalanine; and $X_{18}$ represents glutamic acid (i.e. an enzyme of amino acid sequence SEQ ID NO: 273).

3-HP and Derivatives Thereof

3-HP derivatives include, but are not limited to acrylic acid, 1-propanol, propene, acrylyl-CoA, and polypropylene.

Acetyl-CoA and Derivatives Thereof

Acetyl-CoA derivatives include, but are not limited to acetone, 2-propanol, propene, and polypropylene.

Co-Production of 3-HP and Acetyl-CoA, Salts Thereof, and Derivatives Thereof

The combination of the 3-HP pathway with the acetyl-CoA pathway is adopted here to create a redox balanced pathway resulting in high yield. Between 3-HP derivatives, is possible to cite acrylyc acid, 1-propanol, propene, and polypropylene. Between acetyl-CoA derivatives, is possible to cite acetone, 2-propanol, propene, and polypropylene.

Looking for a solution for the loss of yield for production of 3-HP and acetyl-CoA derivatives, we identify a novel pathway combination of 3-HP derivative production with acetyl-CoA derivative production in a recombinant yeast. 1-propanol biosynthesis from glucose is highly dependent on the availability of reducing power cofactors for the conversion of malonate semialdehyde into 1-propanol: 4 NAD(P)H cofactors are required to convert 1 molecule of malonate semialdehyde into 1 molecule of 1-propanol. Although the biosynthesis of malonate semialdehyde from glucose generates some NAD(P)H cofactors, there is not enough NAD(P)H being formed though to sustain such malonate semialdehyde conversion into 1-propanol. The remaining NAD(P)H cofactors required for the biosynthesis of 1-propanol itself should be provided burning some glucose under aerobic conditions, but reducing so its overall yield potential. The current invention overcomes such redox unbalance and yield potential restriction by combining the biosynthesis of 1-propanol with the biosynthesis of acetone. As acetone is a highly oxidized molecule, its biosynthesis from glucose is linked to the net production of reducing power NAD(P)H cofactors. So, the co-production of both 1-propanol and acetone is redox balanced under certain carbon flow ratio to the target products, since the NAD(P)H required for 1-propanol biosynthesis would come from both glycolysis and acetone biosynthesis.

Figure 15:
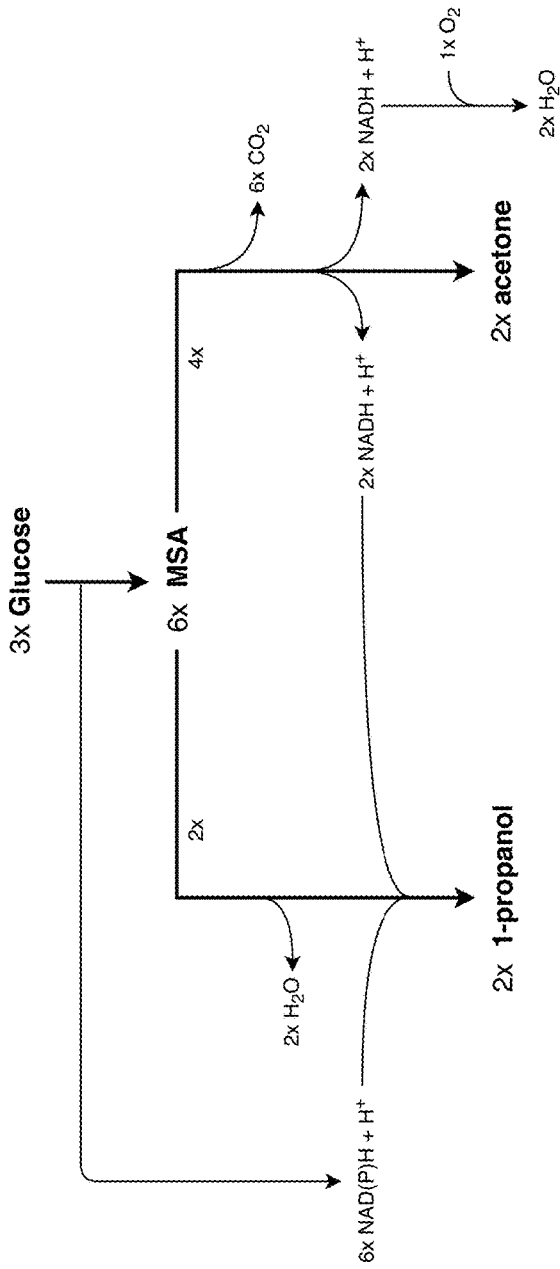
FIG. 15 depicts the stoichiometry of co-production of 1-propanol and acetone in aerobic conditions.
Figure 16:
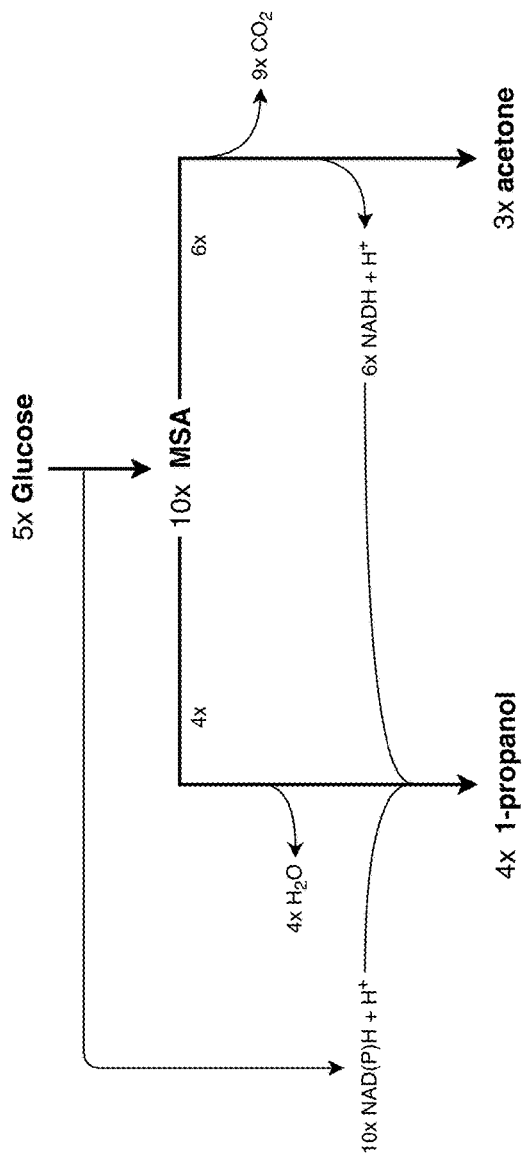
FIG. 16 depicts the stoichiometry of co-production of 1-propanol and acetone in anaerobic conditions.

As described on FIG. 15 and FIG. 16, the co-production of 1-propanol and acetone is redox balanced under both aerobic and anaerobic fermentation conditions, with a yield potential increase under anaerobic condition. The stoichiometry of 1-propanol and acetone co-production pathway under aerobic fermentation condition is: 1 Glucose+0.33 O2→0.67 acetone+0.67 1-propanol+1.33 H2O+2 CO2 with a maximum theoretical yield of 0.437 g/g products per glucose. As shown on FIG. 15, 6 molecules of malonate semialdehyde is produced from 3 molecules of glucose, wherein 4 molecules of malonate semialdehyde goes to the acetone biosynthesis and 2 molecules goes to the 1-propanol biosynthesis adjusting the NAD(P)H cofactors net to a neutral redox balance.

Figure 14:
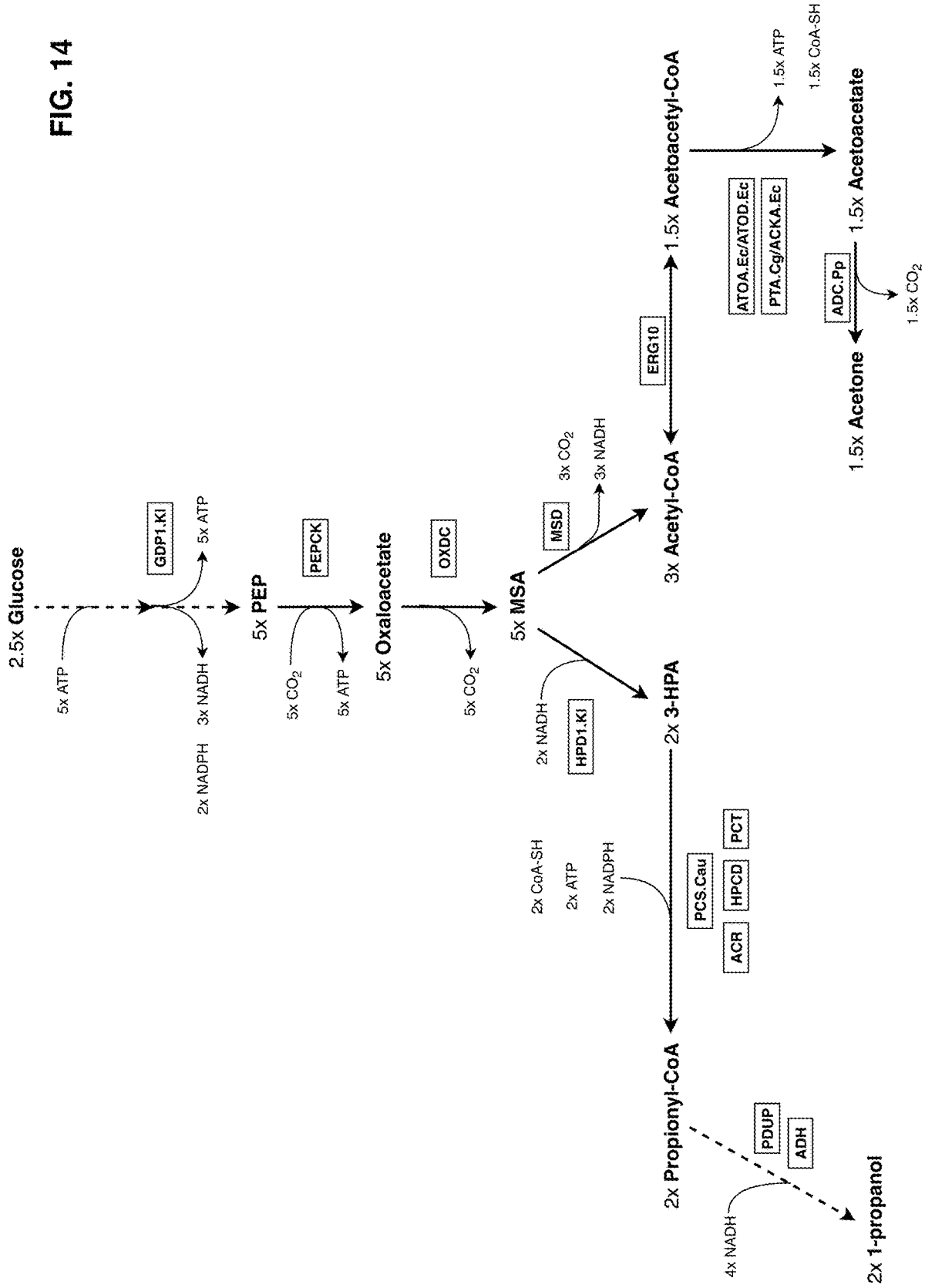
FIG. 14 depicts a co-production pathway of 1-propanol and acetone that shows a neutral redox balance using selected enzymes.

In contrast, the stoichiometry of 1-propanol and acetone co-production pathway under anaerobic fermentation condition is: 1 Glucose→0.6 acetone+0.8 1-propanol+0.8 H2O+1.8 CO2 with a maximum theoretical yield of 0.46 g/g products per glucose. As shown on FIG. 16, 10 molecules of malonate semialdehyde is produced from 5 molecules of glucose, wherein 6 molecules of malonate semialdehyde goes to acetone biosynthesis and 4 goes to 1-propanol biosynthesis in order to have a neutral redox balance. An example of redox balanced 1-propanol and acetone co-production pathway is shown in the FIG. 14 wherein cofactors NADH and NADPH are perfectly equilibrated: the 6 NADH cofactors generated in the upper glycolysis and acetone biosynthesis are consumed in the 1-propanol biosynthesis, and the 2 NADPH cofactors generated in the upper glycolysis are used in the 1-propanol biosynthesis, considering 2.5 molecules of glucose consumed for the production of 2 molecules of 1-propanol and 1.5 molecules of acetone. This can be achieved by using specific enzymes described and listed in the current invention. More precisely, a glyceraldehyde 3-phosphate dehydrogenase enzyme candidate (GAPDH) from *Kluyveromyces lactis* can be used, which show high activity either with NAD+ and NADP+ (and so generating NADH and NADPH), instead of using the native genes from *Saccharomyces cerevisiae* (TDH1, TDH2 and TDH3), which display a strict requirement for NAD+(generating NADH only). Besides, malonate semialdehyde dehydrogenase enzyme candidates from *Pseudomonas aeruginosa* or *Candida albicans* can convert malonate semialdehyde into acetyl-CoA displaying a strict requirement for NAD+ as cofactor. A highly active NADH-dependent 3-hydroxypropionic acid dehydrogenase enzyme from *Candida albicans* (encoded by the gene HPD1) can be used to convert malonate semialdehyde into 3-HP. Finally, the conversion of 3-HP into propionyl-CoA shall be done by using NADPH-dependent enzymes, while 1-propanol production from propionyl-CoA can be performed by NADH-dependent dehydrogenase enzymes. This co-production pathway is redox neutral and with a small excess of ATP, resulting in a more efficient and higher yield production of the desired compounds. Furthermore, the balanced pathway has the potential to be performed under anaerobic conditions, which brings several process advantages when compared with an aerobic process with the same yield. Like for example no air needs to be supplied to the production fermenters, so there is a CAPEX reduction with air compressors and an OPEX reduction with the utilities consumed by these equipment. Another significant advantage is that anaerobic fermenters can have larger maximum sizes than aerobic fermenters, mainly because in aerobic fermenters the oxygen transfer from gas to liquid phase gets more difficult as the size of the fermenter increase, limiting its size to a maximum value, so for the same annual production anaerobic process can have a smaller number of larger fermenters than an aerobic process, which at the end represents a smaller CAPEX with fermenters and its accessories for the anaerobic process. Besides that, there is an improvement of yield in anaerobic conditions, where co-production of 1-propanol and acetone leads to a higher total yield of 0.46 g of solvents/g of glucose, assuming these products are produced in a 3:4 ratio (acetone:1-propanol).

Under anaerobic conditions, the proposed pathway, which includes acetyl-CoA generation from malonate semialdehyde, avoids some of the biggest pathway engineering challenges for acetyl-CoA derivative production, which is acetyl-CoA availability in anaerobic conditions.

Furthermore, the new route for acetyl-CoA production is independent of pyruvate, which is distinct from the typical acetyl-CoA production pathways. In addition, the pathway for 3-HP derivatives is also distinct from the typical 3-HP production pathways, being independent of malonyl-CoA.

In some aspects, the recombinant microorganism is capable of producing acetone from malonate semialdehyde via acetyl-CoA. The proposed acetone pathway relies on the conversion of malonate semialdehyde to acetyl-CoA that is independent of pyruvate, and differs from the typical acetyl-CoA production pathways, mitigating the yield loss by pyruvate deviation to the TCA cycle. Also, malonate semialdehyde is produced by the decarboxylation of oxaloacetate or by the β-alanine pathway, which differs from the naturally malonate semialdehyde produced from malonyl-CoA in yeast. The natural production of malonyl-CoA and its salts is in competition with the ethanol biosynthesis, thus rendering difficult the flux derivation to malonate semialdehyde.

In some aspects, the native glyceraldehyde-3-phosphate dehydrogenase of the microbe is replaced by an exogenous version. The native yeast glyceraldehyde-3-phosphate dehydrogenase catalyzes glyceraldehyde-3-phosphate conversion to 1,3-bisphosphoglycerate resulting in the oxidation of an aldehyde with conversion of $NAD^+$ to NADH. Other versions of this enzyme are described in literature where the enzyme activity results in conversion of $NADP^+$ to NADPH. See Martinez et al. (2008. Metabolic Engineering, 10(6): 352-359). Replacement of the native NAD-dependent enzyme with a NADP-dependent enzyme provides a better balanced pathway favoring production of desired compounds. In some aspects, one or more non-native glyceraldehyde-3-phosphate dehydrogenases replace the native enzyme. In some aspects, the glyceraldehyde-3-phosphate dehydrogenase is selected from a fungi, yeast, bacterium, insect, animal, plant, or flagellate. In some aspects, the glyceraldehyde-3-phosphate dehydrogenase that can be used has, but is not restricted to, EC number 1.2.1.12, such as from Clostridium acetobutylicum (gapC) or Kluyveromyces lactis (gdp1).

The novel combined pathway for 3-HP and acetyl-CoA production has malonate semialdehyde as a common single intermediate. The usual pathway for malonate semialdehyde production has malonyl-CoA as intermediate (Suyama et al., 2017). Otherwise, in the instant pathway, malonate semialdehyde has oxaloacetate as intermediate. See FIG. 1.

The aforementioned issues relating to the traditional pathways of the producing the products, as described above, depress the availability of intermediates and result in enzymes with low activity. As indicated in FIG. 1, the traditional route to malonyl-CoA is from acetyl-CoA, but a considerable portion of the acetyl-CoA is directed towards the TCA cycle. Thus a limited amount of malonyl-CoA is formed (0.01-0.023 nmolmg-1 cell dry weight, which is only 0.5% of the total CoA pool) (Rathnasingh et al., 2012). In addition, malonyl-CoA is an important intermediate in fatty acid metabolism, and it is difficult to redirect this compound into the pathway for the products described herein. Furthermore, the conversion of malonyl-CoA into malonate semialdehyde is performed by a reductase with low activity at 37° C. (maximum activity at 50° C., decrease of 65% at 37° C.) and high Km value for malonyl-CoA (30 µM) (Rathnasingh et al., 2012). The instant pathway is able to clear these issues by utilizing oxaloacetate as an intermediate for malonate semialdehyde production.

Figure 2:
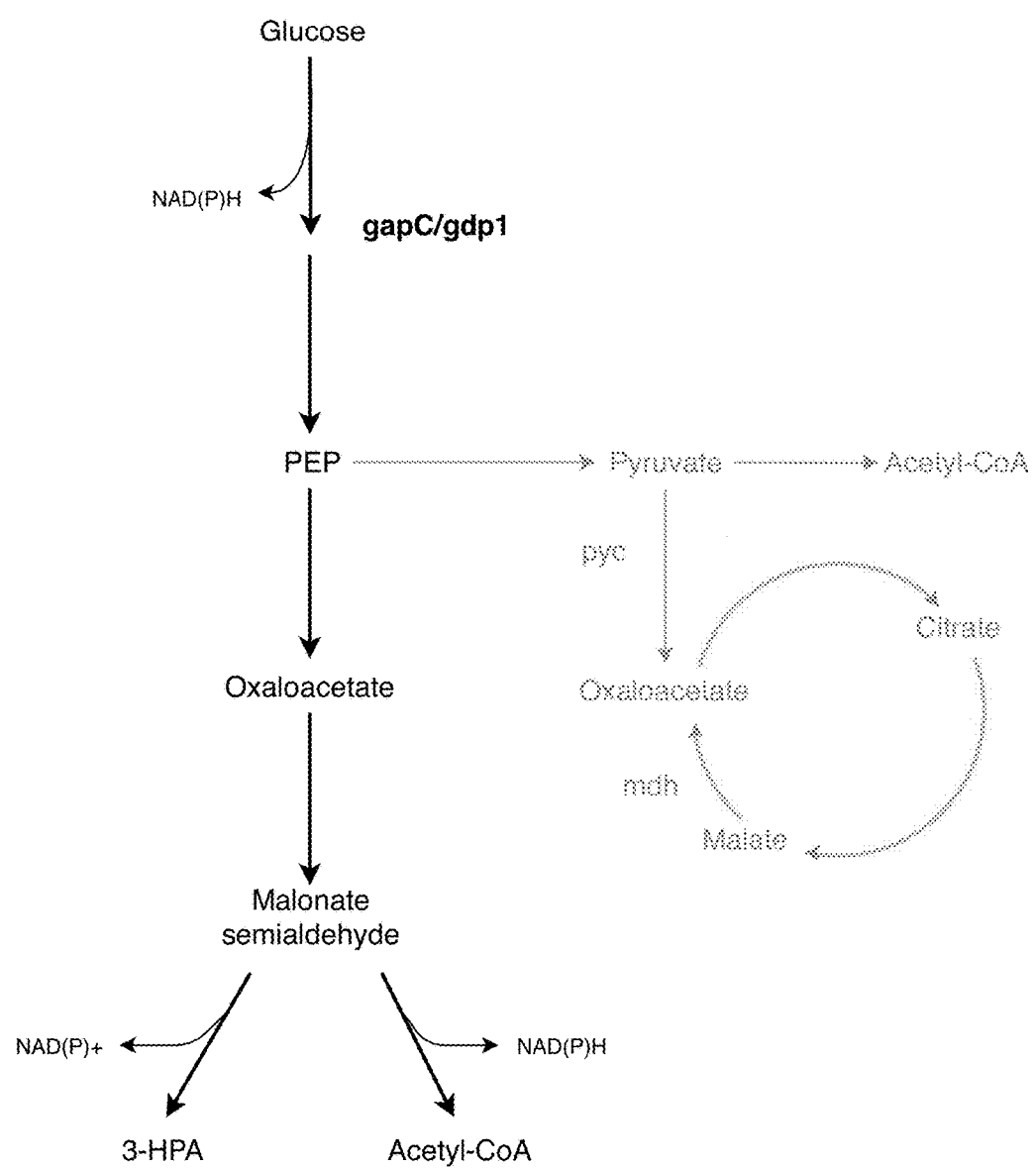
FIG. 2 depicts the two routes for oxaloacetate generation in yeast cells, through pyruvate carboxylase (pyc gene) or malate dehydrogenase (mdh gene) activity.

As depicted in FIG. 2, yeast cells have two routes for oxaloacetate generation; through pyruvate carboxylase (pyc gene) or malate dehydrogenase (mdh gene) activity. As the pyruvate carboxylase is a biotin-dependent enzyme with low catalytic activity, its catalytic turnover is not sufficient to provide high levels of oxaloacetate. Furthermore, oxaloacetate generated by the TCA cycle was found not to be useful to fuel high carbon fluxes. The instant pathway is able to clear these issues by producing oxaloacetate from phosphoenol pyruvate (PEP) instead of from pyruvate. To achieve a high concentration of oxaloacetate, the bacterial enzyme phosphoenol pyruvate carboxylase and/or phosphoenol pyruvate carboxykinase is utilized in the recombinant microbe. In some aspects, the microbe of interest is modified by introduction of one or more phosphoenol pyruvate carboxylase (ppc) and/or one or more phosphoenol pyruvate carboxykinase (pepck). In some aspects, the one or more phosphoenol pyruvate carboxylase (ppc) and/or one or more phosphoenol pyruvate carboxykinase (pepck) are selected from a fungi, yeast, bacterium, insect, animal, plant, or flagellate. In some aspects, the one or more phosphoenol pyruvate carboxylase (ppc) and/or one or more phosphoenol pyruvate carboxykinase (pepck) are from E. coli.

Figure 3:
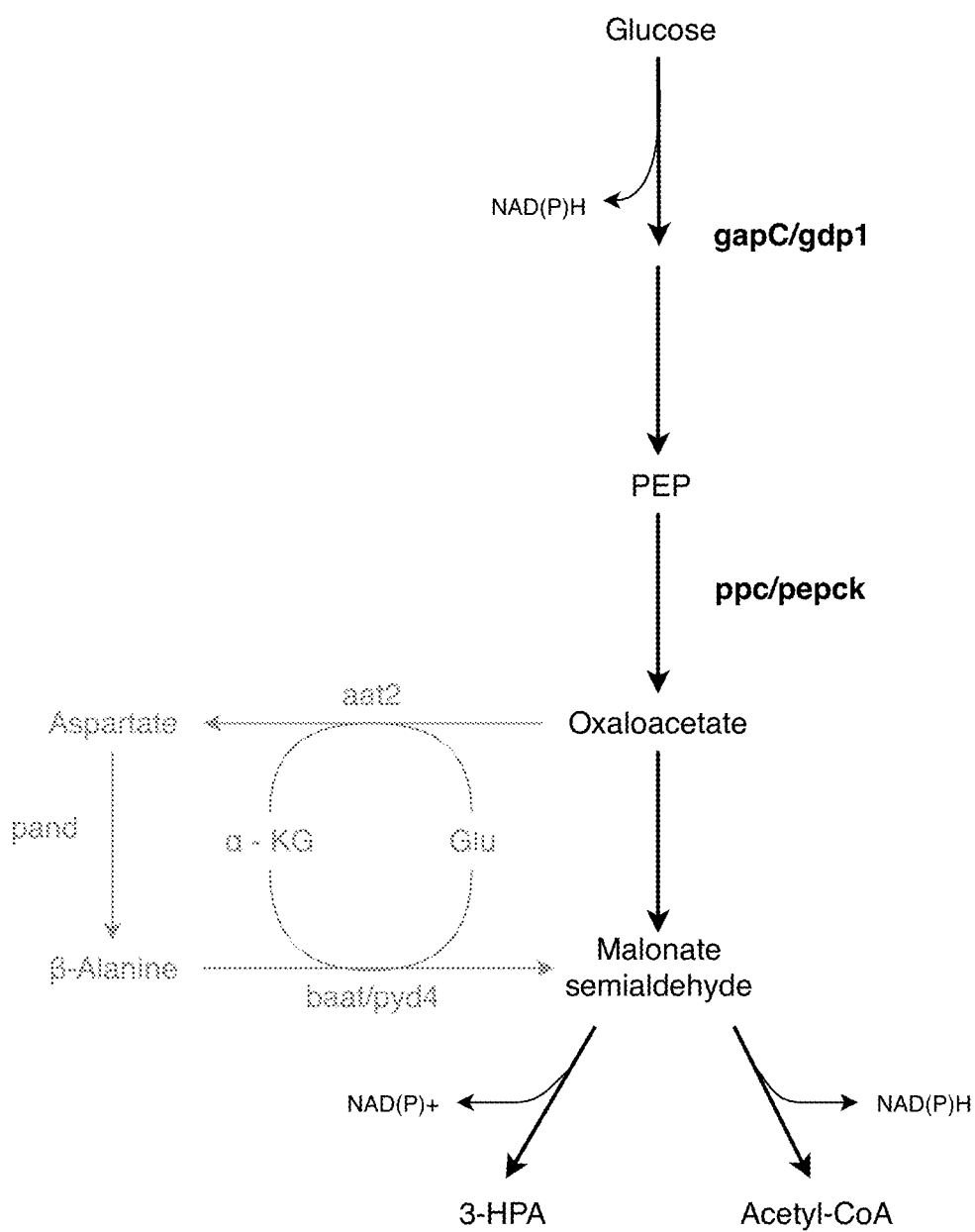
FIG. 3 depicts the pathways from oxaloacetate to malonate semialdehyde. The typical pathway utilizes aspartate and beta-alanine as intermediates, and the new route utilizes a decarboxylase (oxdc) to directly produce malonate semialdehyde from oxaloacetate.

Once oxaloacetate is formed, the molecule can be converted to malonate semialdehyde directly from oxaloacetate or through the intermediary formation of β-alanine, as depicted in FIG. 3.

In some aspects, the malonate semialdehyde directed production from oxaloacetate is performed by a decarboxylase, such as an alpha-ketoisovalerate decarboxylase, benzoylformate decarboxylase, or a 2-oxoglutarate decarboxylase. In some aspects, the recombinant microbe comprises one or more alpha-ketoisovalerate decarboxylase (kdca), benzoylformate decarboxylase (mdlc), and/or 2-oxoglutarate decarboxylase (oxdc). In some aspects, the one or more alpha-ketoisovalerate decarboxylase, benzoylformate decarboxylase, and/or 2-oxoglutarate decarboxylase are selected from a fungi, yeast, bacterium, insect, animal, plant, or flagellate. In some aspects, the alpha-ketoisovalerate decarboxylase is from Lactococcus lactis. In some aspects, the benzoylformate decarboxylase is from Pseudomonas putida. In some aspects, the 2-oxoglutarate decarboxylase is from Oenococcus oeni or Euglena gracilis.

The malonate semialdehyde production through β-alanine involved oxaloacetate transamination to aspartate by an aspartate amino transferase (aat2), aspartate conversion to β-alanine by an aspartate decarboxylase (pand) and β-alanine conversion to malonate semialdehyde by a β-alanine pyruvate amino transferase (baat) and/or β-alanine transaminase (pyd4). In some aspects, the recombinant microbe comprises one or more aspartate amino transferase, aspartate decarboxylase, β-alanine pyruvate amino transferase, and/or β-alanine transaminase. In some aspects, the aspartate amino transferase, aspartate decarboxylase, β-alanine pyruvate amino transferase, and/or β-alanine transaminase are selected from a fungi, yeast, bacterium, insect, animal, plant, or flagellate. In some aspects, the aspartate amino transferase is from *S. cerevisiae*. In some aspects, the aspartate decarboxylase is from *Tribolium castaneum*. In some aspects, the aspartate decarboxylase is from *Corynebacterium glutamicum*. In some aspects, the beta-alanine pyruvate amino transferase is from *Bacillus cereus*. In some aspects, the beta-alanine transaminase is from *Lachancea kluyveri* (Table 16).

Malonate semialdehyde can be converted to 3-HP by a 3-hydroxypropionic acid dehydrogenase. In some aspects, the recombinant microbe comprises one or more 3-hydroxypropionic acid dehydrogenases that can be, but are not restricted to, enzymes with EC number 1.1.1.381 such as those listed in Table 1. In some aspects, the 3-hydroxypropionic acid dehydrogenase is from a fungi, yeast, bacterium, insect, animal, plant, or flagellate. In some aspects, the 3-hydroxypropionic acid dehydrogenase (mcr-1) is from *Chloroflexus aurantiacus*. In some aspects, the 3-hydroxypropionic acid dehydrogenase (adh) is from *Arthrobacter enclensis*. In some aspects, the 3-hydroxypropionic acid dehydrogenase (mmsb) is from *Bacillus cereus*. In some aspects, the 3-hydroxypropionic acid dehydrogenase (ydfg-0) is from *E. coli*. In some aspects, the 3-hydroxypropionic acid dehydrogenase (YDF1) is from *Saccharomyces cerevisiae*. In some aspects, the 3-hydroxypropionic acid dehydrogenase is preferentially (HPD1) from *Candida albicans*,

TABLE 1

Enzymes candidates for conversion to 3-HP from malonate semialdehyde.

| Enzymes | Origin | UniProt number | EC Number | SEQ ID NO |
|---|---|---|---|---|
| MCR-Nterm.Cau | *Chloroflexus aurantiacus* | YP_001636209.1 (NCBI ref seq) | — | 105 |
| ADH.Ae | *Arthrobacter enclensis* | WP_058267460.1 (NCBI ref seq) | — | 106 |
| MMSB.Bce | *Bacillus cereus* | NP_833760.1 (NCBI ref seq) | — | 107 |
| YDFG-0.Ec | *Escherichia coli* | BAA15241.1 (seq nucleotideo) | — | 108 |
| YMR226C (YDF1) | *Saccharomyces cerevisiae* | Q05016 | 1.1.1.381 | 109 |
| HPD1 | *Candida albicans* | A0A1D8PQ07 | | 110 |

Malonate semialdehyde can be converted to acetyl-CoA by a one-step reaction using a malonate semialdehyde dehydrogenase or by a two-step reaction through malonyl-CoA including a malonyl-CoA synthetase or a malonyl-CoA reductase and a malonyl-CoA decarboxylase. In some aspects, a plurality or majority of the malonate semialdehyde is produced from oxaloacetate. In some aspects, a plurality or majority of the malonate semialdehyde is not produced from malonyl-CoA. The enzymes candidates to this step can be, but are not restricted to, enzymes with EC number 1.2.1.18/1.2.1.27 such as those listed in Table 2.

TABLE 2

Enzymes candidates for conversion to acetyl-CoA from malonate semialdehyde

| Genes | Origin | UniProt number | EC Number | SEQ ID NO |
|---|---|---|---|---|
| MSD.Pa | *Pseudomonas aeruginosa* | Q9I702 | 1.2.1.18 | 111 |
| MSD.Cal | *Candida albicans* | A0A1D8PM94 | 1.2.1.18 | 112 |
| iolA | *Listeria monocytogenes* | Q8Y9Y4 | 1.2.1.27 | 113 |
| iolA | *Bacillus subtilis* | A7BJC4 | 1.2.1.27 | 114 |
| iolA | *Cupriavidus necator* | F8GGV48 | 1.2.1.18 | 115 |
| mmsA | *Bacillus cereus* | A0A2C1ZL92 | 1.2.1.27 | 116 |
| dddC | *Halomonas* sp. HTNK1 | C8YX90 | — | 117 |
| iolA | *Lactobacillus casei* | A5YBJ3 | 1.2.1.27 | 118 |

Alternatively, another option to produce acetyl-CoA is a two-step pathway from oxaloacetate and through malonyl-CoA including a 2-keto acid decarboxylase and a malonyl-CoA decarboxylase. See FIG. 4 None of the routes presented utilizes pyruvate as an intermediate, being different from usual pathways and an interesting solution for acetyl-CoA generation in anaerobic conditions, where the availability of cytosolic acetyl-CoA is compromised.

In some aspects, the recombinant microbe comprises one or more malonate semialdehyde dehydrogenase, malonyl-CoA synthetase, malonyl-CoA reductase, malonyl-CoA decarboxylase, and/or 2-keto acid decarboxylase. In some aspects, one or more malonate semialdehyde dehydrogenase, malonyl-CoA synthetase, malonyl-CoA reductase, malonyl-CoA decarboxylase, and/or 2-keto acid decarboxylase are from a fungi, yeast, bacterium, insect, animal, plant, or flagellate. In some aspects, the malonate semialdehyde dehydrogenase that can be used has, but is not restricted to, EC number 1.2.1.18/1.2.1.27 such as those listed in Table 2, preferentially MSD from *Candida albicans* or *Pseudomonas aeruginosa*.

In some aspects, the malonyl-CoA synthetase (MatB) is from *Rhizobium trifohi*. In some aspects, the malonyl-CoA synthetase (AAE13) is from *Arabidopsis thaliana*. In some aspects, the malonyl-CoA synthetase (ACSF3B) is from *Homo sapiens*. In some aspects, the malonyl-CoA reductase (mcr) is from *Chloroflexus aurantiacus*.

In some aspects, the malonyl-CoA decarboxylase (MatA) is from *Rhizobium trifohi*. In some aspects, the malonyl-CoA decarboxylase (MLYCD) is from *Homo sapiens*. In some aspects, the 2-keto acid decarboxylase (kivd) is from *Lactococcus lactis*. In some aspects, the 2-keto acid decarboxylase (KdcA) is from *Lactococcus lactis*. In some aspects, the 2-keto acid decarboxylase (ARO10) is from *Saccharomyces cerevisiae*.

Figure 5:
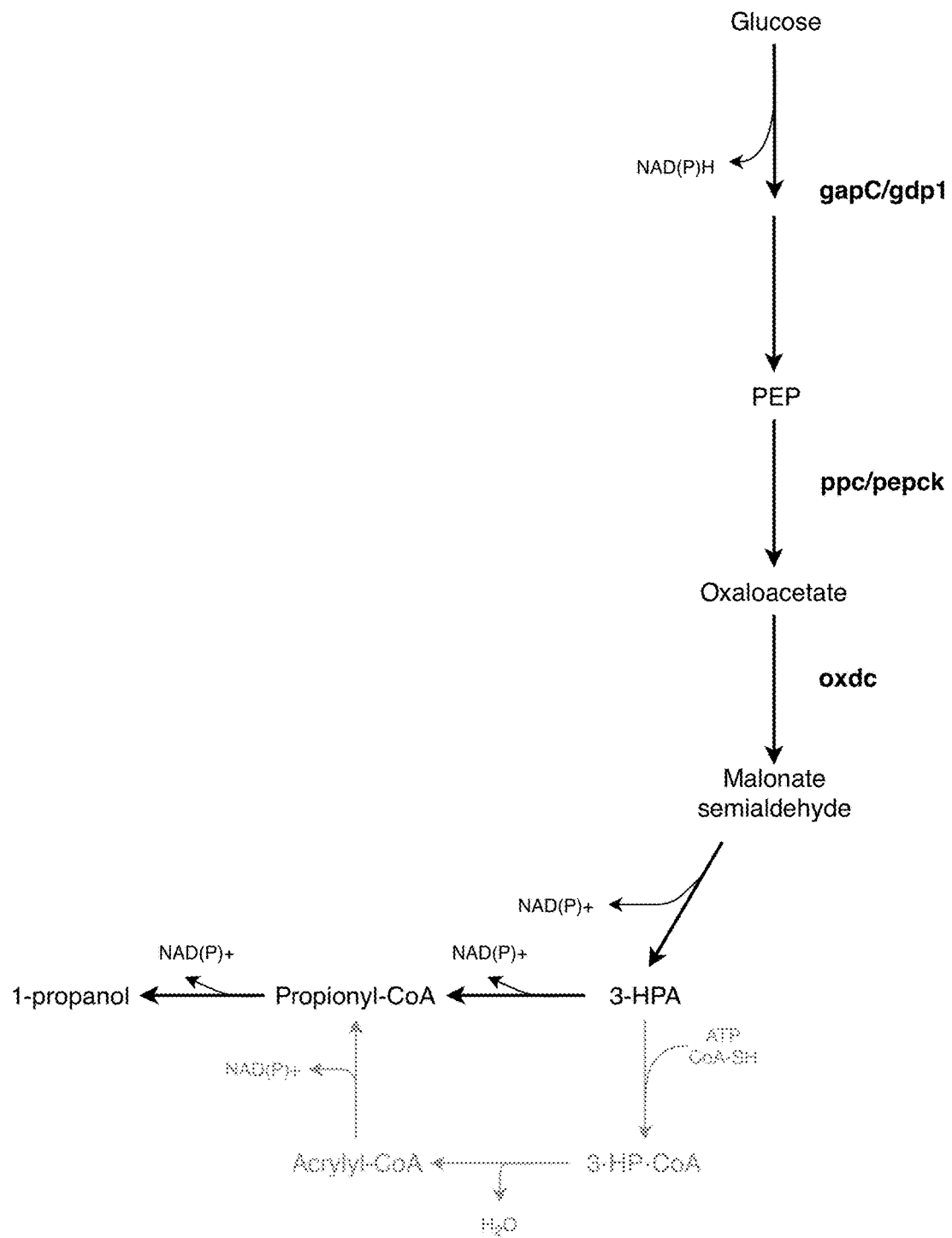
FIG. 5 depicts the pathways for production of 1-propanol from 3-HP by a four-step process and by a 2-step process.

From 3-HP, several compound can be produced, including 1-propanol as an example. For 1-propanol production, 3-HP needs to be converted to propionyl-CoA by a single-step reaction performed by a propionyl-CoA synthase or by multi-step reactions involving a 3-hydroxypropionyl-CoA synthetase, 3-hydroxypropionyl-CoA dehydratase, and acrylyl-CoA reductase. Then propionyl-CoA needs to be converted to 1-propanol by a bifunctional alcohol/aldehyde dehydrogenase (EC number 1.1.1.1/1.2.1.4/1.2.1.5 such as listed in Table 7) or by an aldehyde dehydrogenase (acetylating) (table 8) and an alcohol dehydrogenase (EC number 1.2.1.10/1.2.1.87 such as listed in Table 9). As depicted in FIG. 5, 1-propanol production has a high demand for NAD(P)H, with there being no balanced pathway.

In some aspects, the recombinant microbe comprises one or more propionyl-CoA synthase, 3-hydroxypropionyl-CoA synthetase, 3-hydroxypropionyl-CoA dehydratase, acrylyl-CoA reductase, alcohol/aldehyde dehydrogenase, alcohol dehydrogenase and/or aldehyde dehydrogenase from a fungi, yeast, bacterium, insect, animal, plant, or flagellate. In some aspects, the one or more propionyl-CoA synthase that can be used are enzymes with, but not limited to, EC number 6.2.1.17/6.2.1.36 such as those listed in Table 3. In some aspects, the 3-hydroxypropionyl-CoA synthetase/transferase that can be used, but is not restricted to, is an enzyme with EC number 2.8.3.1/6.2.1.17/6.2.1.36 such as those listed in Table 4. In some aspects, the 3-hydroxypropionyl-CoA dehydratase that can be used, but is not restricted to, is an enzyme with EC number 4.2.1.116/4.2.1.55/4.2.1.150/4.2.1.17 such as those listed in Table 5. In some aspects, the acrylyl-CoA reductase is from, but not limited to, the organisms and/or correspond to the genes indicated in Table 6. In some aspects, the alcohol/aldehyde dehydrogenase, that can be used, but is not restricted to, is an enzyme with EC number 1.1.1.1/1.2.1.4/1.2.1.5 such as those listed in Table 7. In some aspects, other candidates to convert propionyl-CoA to propanol are used (EC number: 1.2.1.10/1.2.1.87 such as listed in Table 8, EC number 2.3.1.8/2.7.2.1 such as listed in Table 9 and EC number 2.3.1.8/2.7.2.1 such as listed in Table 10).

TABLE 47

Enzymes candidates for the conversion of oxaloacetate to acetyl-CoA trough malonyl-CoA

| Genes | Origin | Uniprot number | EC number | SEQ ID NO |
|---|---|---|---|---|
| AAE13 | Arabidopsis thaliana | Q8H151 | 6.2.1.— | 276 |
| matB | Rhizobium trifolii | — | — | — |
| ACSF3 | Homo sapiens | Q4G176 | 6.2.1.— | 277 |
| mcr | Chloroflexus aurantiacus | Q6QQP7 | 1.1.1.298 | 278 |
| mata | Rhizobium trifolii | — | — | — |
| MLYCD | Homo sapiens | O95822 | 4.1.1.9 | 279 |
| kivD | Lactococcus lactis | D2BR82 | — | 280 |
| kdcA | Lactococcus lactis | Q6QBS4 | — | 281 |
| ARO10 | Saccharomyces cerevisiae | Q06408 | — | 282 |

TABLE 3

Enzymes candidates for trifunctional propionyl-CoA synthase.

| Genes | Origin | Uniprot number | EC number | SEQ ID NO |
|---|---|---|---|---|
| PCS.Cau | Chloroflexus aurantiacus | Q8VRG6 | 6.2.1.17 | 119 |
| PCS.Cag | Chloroflexus aggregans | B8G4K4 | 6.2.1.17 | 120 |
| PCS.Rca | Roseiflexus castenholzii | WP_012121416.1 (genebank) | 6.2.1.17 | 121 |
| PCS.No | Natronococcus occultus | WP_015322855.1 (NCBI ref Seq) | 6.2.1.17 | 122 |
| PCS.Hj | Halioglobus japonicus | — | 6.2.1.17 | — |
| NAP1_02725 | Erythrobacter sp NAP1 | A3WE14 | 6.2.1.36 4.2.1.116 1.3.1.84 | 123 |
| AP017312.1 | Aneurinibacillus soli | | | |
| CP0022600.1 | Porphyrobacter HT-58-2 | | | |
| CP017057.1 | Erythrobacter litoralis | | | |
| CP020083.1 | Blasromonas fulva | | | |
| CP003929.1 | Natronococcus occultus | | | |
| CP007793.1 | Azospirillum brasilense | | | |
| CP019450.1 | Halioglobus japonicus | | | |

TABLE 4

Enzymes candidates for conversion to 3-hydroxypropionyl-CoA from 3-HP (3-hydroxypropionyl-CoA synthetase/CoA transferase).

| Genes | Organism | Uniprot number | EC number | SEQ ID NO |
|---|---|---|---|---|
| PCT-0.Cne (pct) | Cupriavidus necator | Q0K874 | 2.8.3.1 | 124 |
| PCT-0.Cp (pct) | Clostridium propionicum | Q9L3F7 | 2.8.3.1 | 125 |
| PCT or YdiF | Megasphaera elsdenii | G0VND6 | 2.8.3.1 | 126 |
| PrpE | Salmonella enterica | P55912 | 6.2.1.17 | 127 |
| Nmar_1309 | Nitrosopumilus maritimus | A9A2G6 | — | 128 |
| Msed_1456 | Metallosphaera sedula | A4YGR1 | 6.2.1.36 | 129 |
| PrpE | Escherichia coli | P77495 | 6.2.1.17 | 130 |
| YdiF | Cupriavidus necator | Q0K874 | 2.8.3.1 | 131 |
| STK_07830 | Sulfolobus tokodaii | Q973W5 | 6.2.1.36 | 132 |

TABLE 5

Enzymes candidates for conversion to acrylyl-CoA from 3-Hydroxypropionyl-CoA (3-hydroxypropionyl-coA dehydratase/enoyl-CoA hydratase)

| Genes | Organism | Uniprot number | EC number | SEQ ID NO |
|---|---|---|---|---|
| HPCD.Mse | Metallosphaera sedula | A4YI89 | 4.2.1.116 | 133 |
| HPDC.Bsp | Bacillus sp. | A0A1B9ACR9 | — | 134 |
| HPCD.Sac | Sporanaerobacter acetigenes | A0A1M5Y529 | — | 135 |
| ENCD.Rp | Ruegeria pomeroyi | Q5LMB7 | — | 136 |
| 3HPCD | Sulfolobus tokodaii | F9VNG3 | 4.2.1.116 | 137 |
| Nmar_1308 | Nitrosopumilus maritimus | A9A2G5 | 4.2.1.116 | 138 |
| Hpcd | Chloroflexus aurantiacus | — | 4.2.1.116 | — |
| crt | Clostridium acetobutylicum | P52046 | 4.2.1.55/ 4.2.1.150 | 139 |
| 3-hydrobutyryl-coa dehydratase | Clostridium pasteuranum | L7EP14 | 4.2.1.55 | 140 |
| crt | Clostridium pasteuranum | P81357 | 4.2.1.150 | 141 |
| MELS_1449 | Megasphaera elsdenii | G0VQE2 | 4.2.1.55 | 142 |
| Aflv_0566 | Anoxybacillus flavithermus | B7GGZ2 | 4.2.1.17 | 143 |

TABLE 6

Enzymes candidates for conversion to Propionyl-CoA from Acrylyl-CoA (acrylyl-CoA reductase).

| Genes | Organism | Uniprot number | EC number | SEQ ID NO |
|---|---|---|---|---|
| ACR-0.Rp | Ruegeria pomeroyi | Q5LS56 | 1.3.1.84 | 144 |
| ACR-0.Ec | Escherichia coli | P26646 | 1.3.1.84 | 145 |
| ACR-0.Rs | Rhodobacter sphaeroides | Q3J6K9 | 1.3.1.84 | 146 |
| acuI | Ruegeria pomeroyi | Q5LS56 | 1.3.1.84 | 147 |
| acuI | Rhodobacter sphaeroids | Q3J6K9 | 1.3.1.84 | 148 |
| β-ETF, α-ETF and Propionyl-coA dehydrogenase | Clostridium propionicum | G3KIM6, G3KIM7 and G3KIM8 | 1.3.1.95 | 149 |
| acuI | Alcaligenes faecalis | A0A3G6HCN9 | 1.3.1.95 | 150 |
| ACR | Sulfurisphaera tokodaii | Q975C8 | 1.3.1.84 | 151 |

TABLE 6-continued

Enzymes candidates for conversion to Propionyl-
CoA from Acrylyl-CoA (acrylyl-CoA reductase).

| Genes | Organism | Uniprot number | EC number | SEQ ID NO |
|---|---|---|---|---|
| AcuI | Escherichia coli | P26646 | 1.3.1.84 | 152 |
| Acr | Metallosphaera sedula | A4YGN2 | 1.3.1.84 | 153 |
| Nmar_1565 | Nitrosopumilus maritimus | A9A5Y3 | — | 154 |

TABLE 7

Enzymes candidates for conversion to Propanol from
Propionyl-CoA (alcohol/aldehyde dehydrogenase)

| Genes | Origin | UniProt number | EC number | SEQ ID NO |
|---|---|---|---|---|
| ADHE.Ca | Clostridium acetobutylicum | Q9ANR5 | — | 155 |
| ADHE.Cbe | Clostridium beijerinckii | A0A1S8PSK3 | — | 156 |
| ADHE.St | Salmonella typhimurium | P74880 | — | 157 |
| ADHE.Car | Clostridium arbusti | WP_010241373.1 (NCBI Ref Seq) | — | 158 |
| adhE | Escherichia coli | P0A9Q7 | 1.1.1.1 | 159 |
| adhP | Escherichia coli | P39451 | 1.1.1.1 | 160 |
| bdhB | Clostridium acetobutylicum | Q04945 | 1.1.1.1 | 161 |
| ADH2 | Saccharomyces cerevisiae | P00331 | 1.1.1.1 | 162 |
| adhE | Clostridium roseum | — | — | — |
| adhA | Thermoanaerobacterium saccharolyticum | I3VX46 | — | 163 |
| ald6 | Saccharomyces cerevisiae | P54115 | 1.2.1.4 | 164 |
| aldh3A1 | Homo sapiens | P30838 | 1.2.1.5 | 165 |

TABLE 8

Enzymes candidates for conversion of propionyl-CoA to
propionaldehyde (aldehyde dehydrogenase (acetylating))

| Genes | Origin | UniProt number | EC number | SEQ ID NO |
|---|---|---|---|---|
| MHPF.Ec | Escherichia coli | WP_097337838.1 (NCBI ref seq) | 1.2.1.10 | 166 |
| MHPF.Ppu | Pseudomonas putida | YP_003617188.1 (NCBI ref seq) | 1.2.1.10 | 167 |
| MHPF.Pse | Pseudomonas sp. | CRM99844.1 (NCBI ref Seq) | 1.2.1.10 | 168 |
| MHPF.Pf | Pseudomonas fluorescens | BAA09693.1 (gene Bank) | 1.2.1.10 | 169 |
| MHPF.Px | Paraburkholderia xenovorans | Q79AF6 | 1.2.1.10 | 170 |
| PDUP.Sen | Salmonella enterica | AAD39015.1 (H9L4I6) | — | 171 |
| PDUP1.Lmo | listeria monocytogenes | NP 464690.1 (Q8Y7V4) | — | 172 |
| PDUP2.Lmo | listeria monocytogenes | A0A0E0UUX4 | — | 173 |
| PDUP.Kp | Klebsiella pneumoniae | YP_001336844.1 | — | 174 |

TABLE 8-continued

Enzymes candidates for conversion of propionyl-CoA to propionaldehyde (aldehyde dehydrogenase (acetylating))

| Genes | Origin | UniProt number | EC number | SEQ ID NO |
|---|---|---|---|---|
| aldH | *Acinetobacter* sp. | A5JT11 | 1.2.1.10 | 175 |
| Ald | *Clostridium beijerinckii* | Q9X681 | 1.2.1.10 | 176 |
| Cphy1178 | *Clostridium phytofermentans* | A9KN57 | — | 177 |
| tesF | *Comamonas testosteroni* | Q83VZ4 | 1.2.1.10 | 178 |
| BN476_01309 | *Eubacterium hallii* | R6G856 | — | 179 |
| PduP | *Lactobacillus collinoides* | Q845A7 | — | 180 |
| EutE | *Lactobacillus reuteri* | A0A1B7LQN5 | — | 181 |
| HsaG | *Mycobacterium tuberculosis* | A0A2I7WCV7 | 1.2.1.10 | 182 |
| MhpF | *Mycobacterium tuberculosis* | P9WQH3 | 1.2.1.10 | 183 |
| bphJ | *Paraburkholderia xenovorans* | Q79AF6 | 1.2.1.10 / 1.2.1.87 | 184 |
| SAMN04244550_00489 | *Rhodobacter capsulatus* | A0A1G7D6K3 | — | 185 |
| hsaG | *Rhodococcus jostii* | Q0S816 | 1.2.1.10 | 186 |
| RPC_1174 | *Rhodopseudomonas palustris* | Q21A49 | — | 187 |
| TTHB247 | *Thermus thermophilus* | Q53WH9 | 1.2.1.10 / 1.2.1.87 | 188 |

TABLE 9

Enzymes candidates for conversion to propanol from propionaldehyde

| Genes | Origin | UniProt number | EC number | SEQ ID NO |
|---|---|---|---|---|
| alrA | *Acinetobacter* sp | Q9F1R1 | 1.1.1.2 | 189 |
| Aldehyde reductase | *Acinetobacter* sp. | Q9F1Q8 | 1.1.1.2 | 190 |
| bdhI | *Clostridium acetobutylicum* | Q04944 | 1.1.1.— | 191 |
| bdhII | *Clostridium acetobutylicum* | Q04945 | 1.1.1.— | 192 |
| adhA | *Corynebacterium glutamicum* | A0A169S5A7 Q8NLX9 | 1.1.1.1 | 193 194 |
| yqhD | *Escherichia coli* | Q46856 | 1.1.1.2 | 195 |
| yjgB | *Escherichia coli* | P27250 | 1.1.1.2 | 196 |
| adhP | *Escherichia coli* | P39451 | 1.1.1.1 | 197 |
| PduQ | *Propionibacterium freudenreichii* | A0A2C8A2U1 | — | 198 |
| ADH1 | *Saccharomyces cerevisiae* | P00330 | 1.1.1.1 | 199 |
| ADH2 | *Saccharomyces cerevisiae* | P00331 | 1.1.1.1 | 200 |
| ADH4 | *Saccharomyces cerevisiae* | P10127 | 1.1.1.1 | 201 |
| ADH6 | *Saccharomyces cerevisiae* | Q04894 | 1.1.1.2 | 202 |
| PduQ (adhE_2) | *Salmonella enterica* | H9L4H8 | — | 203 |
| Adh | *Sulfolobus tokodaii* | Q96XE0 | 1.1.1.1 | 204 |
| adhA | *Synechocystis* sp | P74721 | — | 205 |
| adhA | *Zymommonas mobilis* | P20368 | 1.1.1.1 | 206 |

TABLE 10

Enzymes candidates for conversion to propionaldehyde from propionyl-CoA

| Genes | Origin | UniProt number | EC number | SEQ ID NO |
|---|---|---|---|---|
| PTA.Cg | *Corynebacterium glutamicum* | WP_011015350 (NCBI ref seq) | 2.3.1.8 | 207 |
| ACKA.Cg | *Corynebacterium glutamicum* | P77845 | 2.7.2.1 | 208 |

Figure 6:
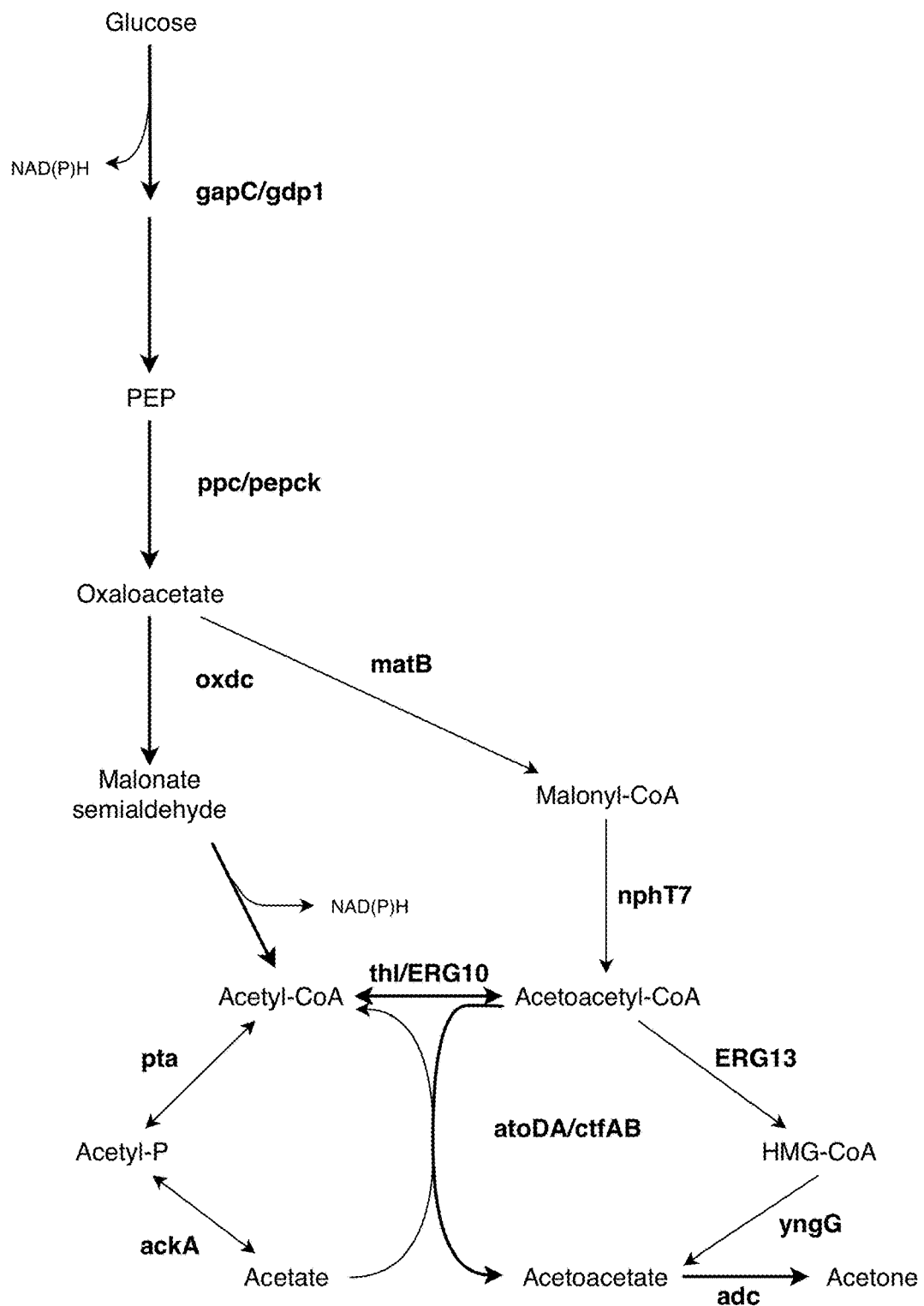
FIG. 6 the pathways to acetone production from glucose, and the excess of NAD(P)H produced in the pathways.

From acetyl-CoA, several compound can be produced, being possible to cite acetone as an example. For acetone production, acetyl-CoA needs to be converted to acetoacetyl-CoA by a thiolase or an acetyl-CoA acetyltransferase. Alternatively, acetoacetyl-CoA can be formed through malonyl-CoA by acetoacetyl-CoA synthase. Once acetoacetyl-CoA is formed, its conversion to acetoacetate can be done by an acetoacetyl-CoA transferase or through HMG-CoA by hydroxymethylglutaryl-CoA synthase and hydroxymethylglutaryl-CoA lyase. Acetoacetate conversion to acetone is done by an acetoacetate decarboxylase. As depicted in FIG. 6, acetone production has an excess of NAD(P)H, being also a no balanced pathway.

In some aspects, the recombinant microbe comprises one or more thiolase, acetyl-CoA acetyltransferase, acetoacetyl CoA synthase, acetoacetyl-CoA transferase, hydroxymethylglutaryl-CoA synthase, hydroxymethylglutaryl-CoA lyase, and/or acetoacetate decarboxylase from a fungi, yeast, bacterium, insect, animal, plant, or flagellate. In some aspects, the one or more thiolase or acetyl-CoA acetyltransferase that can be used has, but is not restricted to, EC number 2.3.1.9 such as those listed in Table 11 and acetoacetyl-CoA transferase that can be used has, but is not restricted to, EC number 2.8.3.8/2.8.3.9 such as those listed in Table 12, hydroxymethylglutaryl-CoA synthase, hydroxymethylglutaryl-CoA lyase, and/or acetoacetate decarboxylase that can be used has, but is not restricted to, an enzyme with EC number 4.1.1.4 such as those listed in Table 13.

TABLE 11

Enzymes candidates for conversion to acetoacetyl-CoA from acetyl-CoA (acetyltransferase)

| Genes | Origin | UniProt number | EC number | SEQ ID NO |
|---|---|---|---|---|
| ERG10 | Saccharomyces cerevisiae | P41338 | 2.3.1.9 | 209 |
| thlA | Clostridium acetobutylicum | P45359 | 2.3.1.9 | 210 |
| atoB | Escherichia coli | P76461 | 2.3.1.9 | 211 |
| H16_B0759 | Cupriviadus necator | Q0K368 | 2.3.1.9 | 212 |
| Msed_0656 | Metallosphaera sedula | A4YEH9 | 2.3.1.9 | 213 |
| AAT1 | Arabidopsis thaliana | Q8S4Y1 | 2.3.1.9 | 214 |

TABLE 12

Enzymes candidates for conversion to acetoacetate from acetoacetyl-CoA (acetoacetyl-CoA transferase/synthase)

| Genes | Origin | UniProt number | EC number | SEQ ID NO |
|---|---|---|---|---|
| ATOA.Ec/ | Escherichia | P76459 | 2.8.3.8 | 215 |
| ATOD.Ec | coli | P76458 | | 216 |
| C7401_123119 | Paraburkholderia unamae | A0A328X8N5 | 2.8.3.8 | 217 |
| YdiF | Escherichia coli | Q8X5X6 | 2.8.3.8 | 218 |
| ctfA.Ca/ctfB | Clostridium acetobutylicum | P33752 P23673 | 2.8.3.9 | 219 220 |
| ctfA./ctfB | Clostridium saccharobutylicum | U5MXH7 U5MUQ0 | 2.8.3.9 | 221 222 |
| ctfA/ctfB | Escherichia coli | A0A2X1MWL8 A0A0K5TTP4 | 2.8.3.9 | 223 224 |
| ERG13 | Saccharomyces cerevisiae | P54839 | 2.3.3.10 | 283 |
| yngG | Bacillus subtilis | O34873 | 4.1.3.4 | 284 |
| nphT7 | Streptomyces sp. | D7URV0 | 2.3.1.194 | 285 |

TABLE 13

Enzymes candidates for conversion to acetone from acetoacetate (acetoacetate decarboxylase)

| Genes | Origin | UniProt number | EC number | SEQ ID NO |
|---|---|---|---|---|
| Adc.Ca | Clostridium acetobutylicum | P23670 | 4.1.1.4 | 225 |
| Adc.Cbe | Clostridium beijerinckii | A6M020 | 4.1.1.4 | 226 |
| Adc | Clostridium pasteurianum | P23650 | 4.1.1.4 | 227 |
| Adc | Pseudomonas solanacearum | Q8XR10 | 4.1.1.4 | 228 |
| Adc | Paraburkholderia xenovorans | Q141C9 | 4.1.1.4 | 229 |
| Adc.Pp | Paenibacillus polymyxa | A0A378XWA9 | — | 230 |

Figure 7:
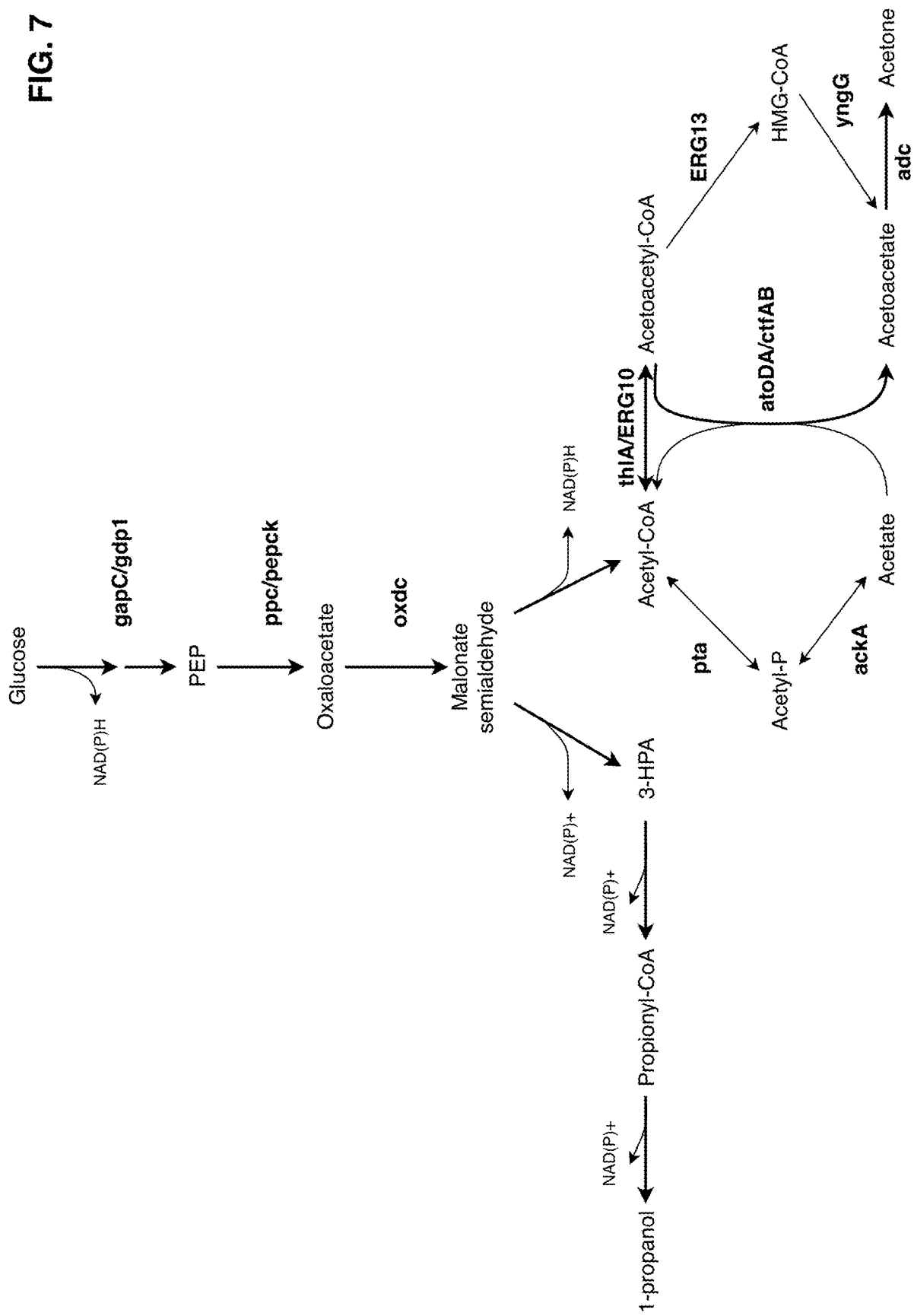
FIG. 7 depicts the combined pathways from oxaloacetate to malonate semialdehyde to 1-propanol and acetone, and the redox neutral status of the combined pathways.
Figure 8:
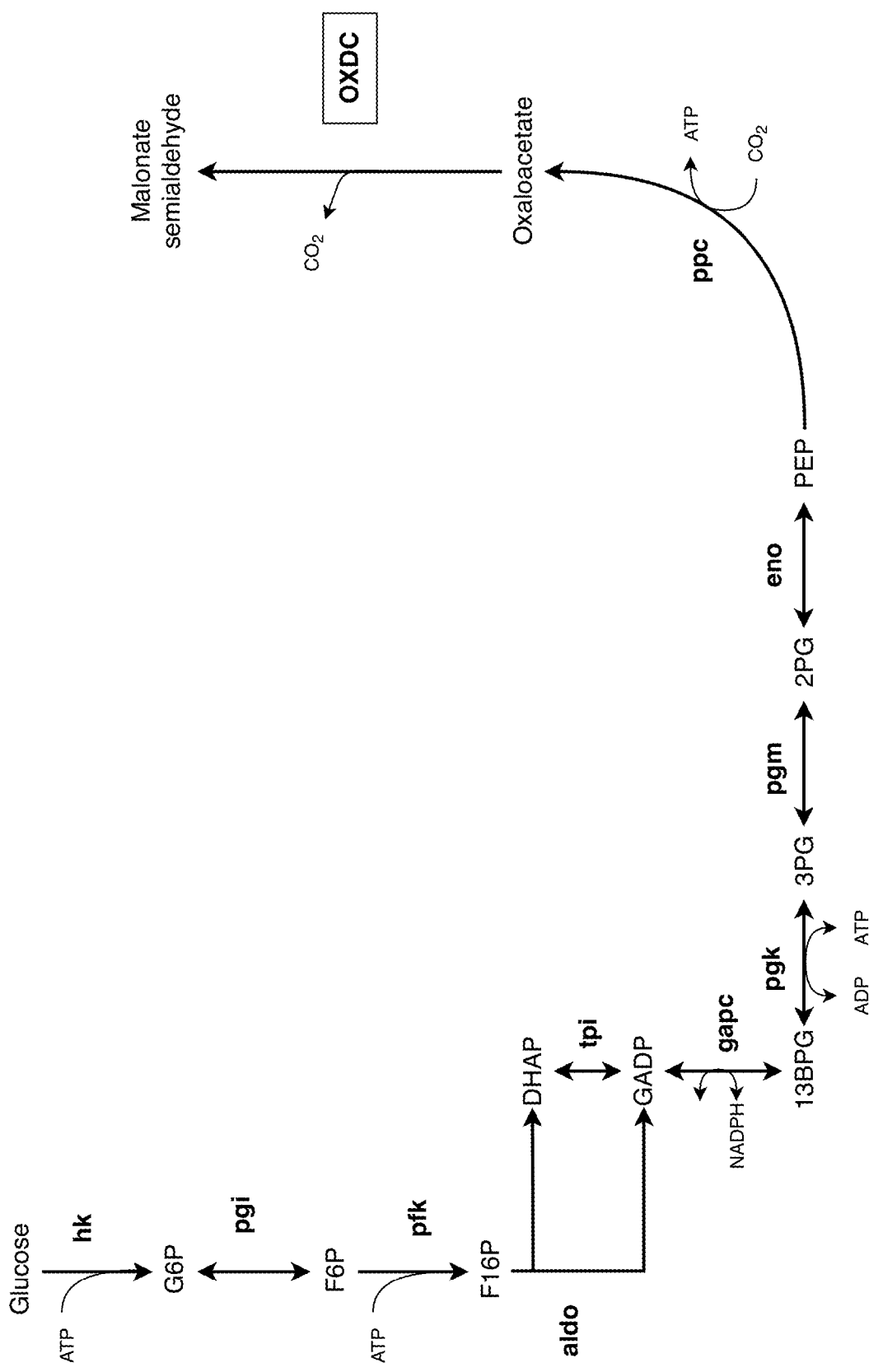
FIG. 8 depicts a pathway from glucose to malonate semialdehyde, including catalytic enzymes and corresponding malonate semialdehyde intermediates, particularly identifying the oxaloacetate decarboxylase utilized to produce malonate semialdehyde from oxaloacetate.

To solve high demand of NAD(P)H related to 3-HP derivatives production and excess of NADH related to acetyl-CoA derivatives production, we are suggesting the combination of both pathways to result in a balanced pathway. As depicted in FIG. 7, combination of these pathways for 1-propanol and acetone, for example, leads to a high total yield of 0.437 g of solvents/g of glucose, assuming these products are produced in a 1:1 ratio (acetone:1-propanol) in aerobic conditions (FIG. 15). The proposed co-production pathway is redox neutral and with a small excess of ATP, results in a more efficient and high yield production of the desired compounds. Furthermore, balanced pathway has potential to be performed in an anaerobic condition, which may represent a potential for a lower production cost process, due to advantages already mentioned, like CAPEX and OPEX reduction with air compressors, and CAPEX decrease with production fermenters. Besides that, there is an improvement of yield in anaerobic conditions, where co-production of 1-propanol and acetone leads to a higher total yield of 0.46 g of solvents/g of glucose, assuming these products are produced in a ratio 3:4 (acetone:1-propanol) (FIG. 16).

Figure 17:
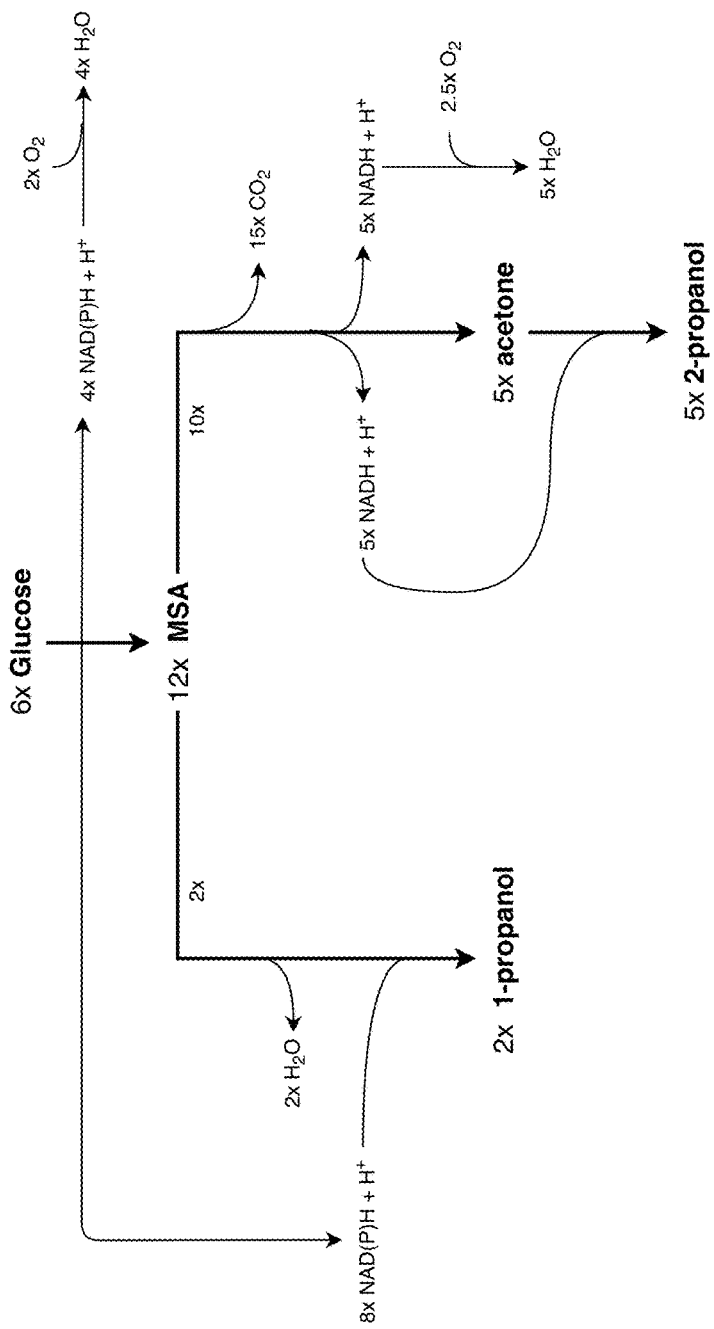
FIG. 17 depicts the stoichiometry of co-production of 1-propanol and 2-propanol in aerobic conditions.

In some aspects, 2-propanol can be obtained by dehydrogenation of acetone and can be coproduced with 1-propanol. The NADPH/NADH requirements in the 3-HPA derivative pathway complements the NADPH/NADH excess from the acetyl-CoA derivative pathway. The combination of these pathways for the production of 1-propanol and 2-propanol, leads to a high total yield of 0.39 g of solvents/g of glucose, assuming these products are produced in a 2:5 ratio (1-propanol:2-propanol), in aerobic conditions, according to FIG. 17.

Figure 18:
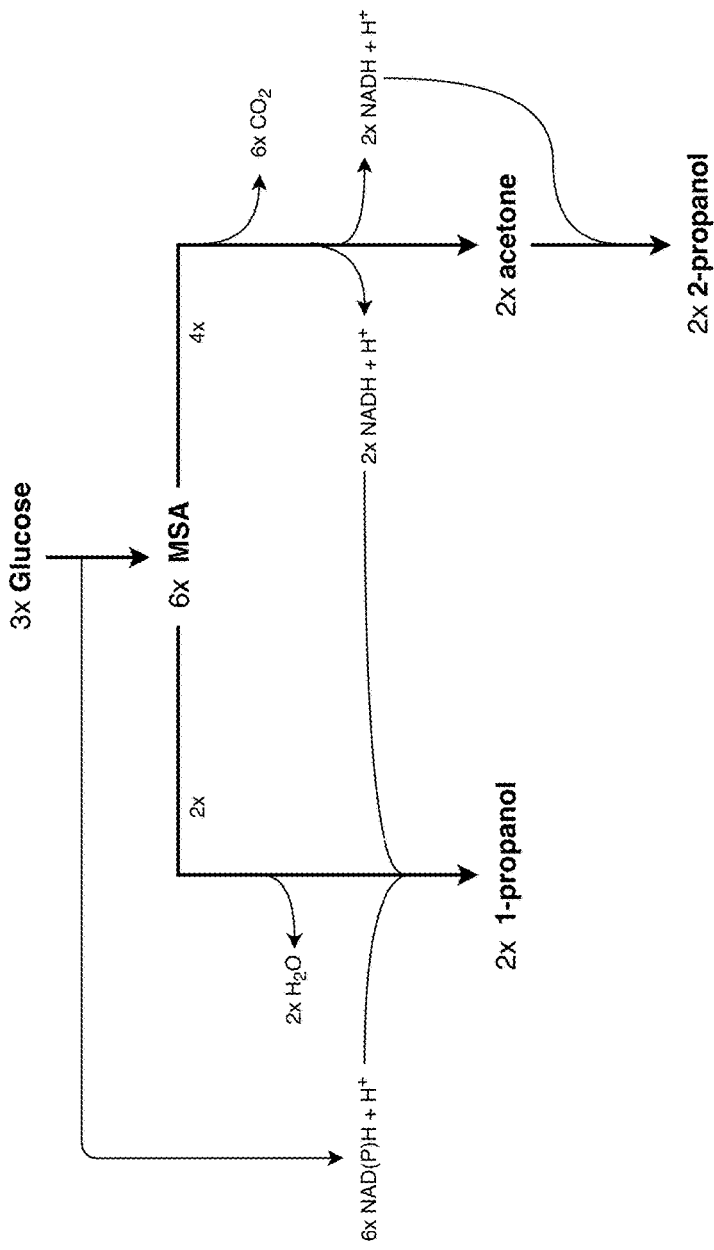
FIG. 18 depicts the stoichiometry of co-production of 1-propanol and 2-propanol in anaerobic conditions.
Figure 19:
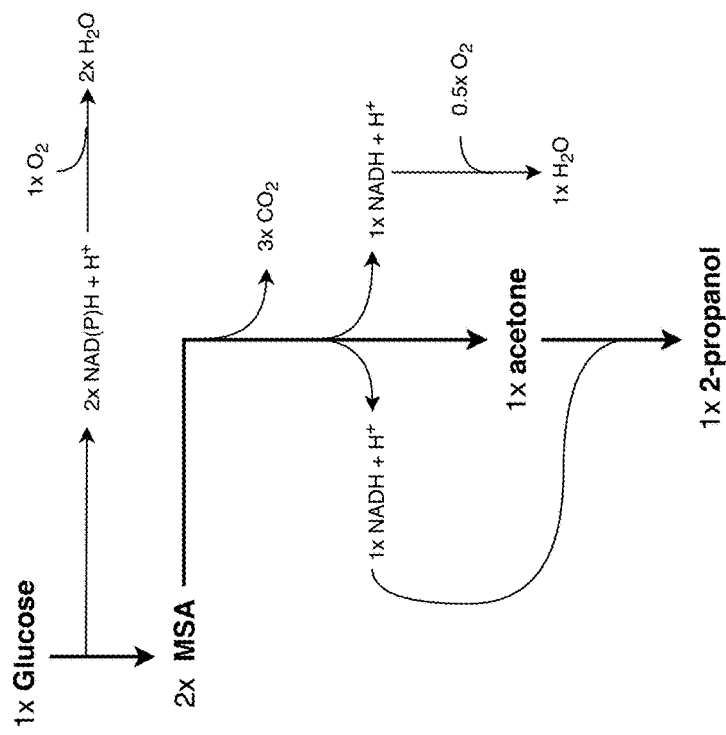
FIG. 19 depicts the stoichiometry of production of 2-propanol in aerobic conditions.

In some aspects, 2-propanol can be obtained by enzymatic dehydrogenation of acetone and can be coproduced with 1-propanol in anaerobic conditions, that leads to a higher total yield of 0.44 g of solvents/g of glucose, assuming these products are produced in a 1:1 ratio (1-propanol:2-propanol), in anaerobic conditions, according to FIG. 18. This process may represent a potential for a lower cost process, in relation to an aerobic process.

TABLE 14

Enzymes to convert acrylyl-CoA to acrylic acid (acyl-CoA hydrolase or thioesterase)

| Genes | Origin | UniProt number | EC number | SEQ ID NO |
|---|---|---|---|---|
| yciA | Escherichia coli | P0A8Z0 | — | 231 |
| ACIAD3139 | Escherichia coli | Q6F7Y5 | — | 232 |

TABLE 15

Enzymes candidates to 2-propanol dehydrogenase

| Genes | Origin | UniProt number | EC number |
|---|---|---|---|
| PRDH.Dr | Devosia riboflavina | — | — |
| PRDH.Sp | Sporotrichum pulverulentum | — | — |

TABLE 16

Genes involved on malonate semialdehyde production by p-alanine pathway

| Genes | Origin | UniProt number | EC number | SEQ ID NO |
|---|---|---|---|---|
| aat2 | Saccharomyces cerevisiae | P23542 | 2.6.1.1 | 233 |
| PAND | Corynebacterium glutamicum | A4QAD0 | 4.1.1.11 | 234 |
| PAND.Tca | Tribolium castaneum | A7U8C7 | 4.1.1.11 | 275 |
| Baat | Saccharomyces cerevisiae | P47176 | 2.6.1.42 | 235 |
| PYD4.Lk | Lachancea kluyveri | A5H0J5 | 2.6.1.19 | 236 |

TABLE 17

Genes of glycolysis

| Genes | Origin | UniProt Number | EC number | SEQ ID |
|---|---|---|---|---|
| PEPCK | Escherichia coli | P22259 | 4.1.1.49 | 237 |
| GAPDH | Saccharomyces cerevisiae | P00359 | 1.2.1.13 | 238 |
| GDP1.K1 | Kluyveromyces lactis | Q8J0C9 | 1.2.1.13 | 239 |
| PYK1 | Saccharomyces cerevisiae | P00549 | 2.7.1.40 | 240 |
| gapC | Clostridium acetobutylicum | Q97D25 | 1.2.1.13 | 241 |

Methods of Detecting Genetic Modification

The present disclosure teaches primers, probes, and assays that are useful for detecting the microbes taught herein. In some aspects, the disclosure provides for methods of detecting the WT parental strains. In other aspects, the disclosure provides for methods of detecting the engineered or modified microbes derived from parent strains or WT strains. In some aspects, the present disclosure provides methods of identifying genetic alterations in a microbe.

In some aspects, the genomic engineering methods of the present disclosure lead to the creation of non-natural nucleotide "junction" sequences in the modified microbes. These non-naturally occurring nucleotide junctions can be used as a type of diagnostic that is indicative of the presence of a particular genetic alteration in a microbe taught herein.

The present techniques are able to detect these non-naturally occurring nucleotide junctions via the utilization of specialized quantitative PCR methods, including uniquely designed primers and probes. In some aspects, the probes of the disclosure bind to the non-naturally occurring nucleotide junction sequences. In some aspects, traditional PCR is utilized. In other aspects, real-time PCR is utilized. In some aspects, quantitative PCR (qPCR) is utilized. In some aspects, the PCR methods are used to identify heterologous sequences that have been inserted into the genomic DNA or extra-genomic DNA of the microbes.

Thus, the disclosure can cover the utilization of two common methods for the detection of PCR products in real-time: (1) non-specific fluorescent dyes that intercalate with any double-stranded DNA, and (2) sequence-specific DNA probes consisting of oligonucleotides that are labelled with a fluorescent reporter which permits detection only after hybridization of the probe with its complementary sequence. In some aspects, only the non-naturally occurring nucleotide junction will be amplified via the taught primers, and consequently can be detected via either a non-specific dye, or via the utilization of a specific hybridization probe. In other aspects, the primers of the disclosure are chosen such that the primers flank either side of a junction sequence, such that if an amplification reaction occurs, then said junction sequence is present.

Aspects of the disclosure involve non-naturally occurring nucleotide junction sequence molecules per se, along with other nucleotide molecules that are capable of binding to said non-naturally occurring nucleotide junction sequences under mild to stringent hybridization conditions. In some aspects, the nucleotide molecules that are capable of binding to said non-naturally occurring nucleotide junction sequences under mild to stringent hybridization conditions are termed "nucleotide probes."

In some aspects, genomic DNA can be extracted from samples and used to quantify the presence of microbes of the disclosure by using qPCR. The primers utilized in the qPCR reaction can be primers designed by Primer Blast (www.ncbi.nlm.nih.gov) to amplify unique regions of the wild-type genome or unique regions of the engineered non-intergeneric mutant strains. The qPCR reaction can be carried out using the SYBR GreenER qPCR SuperMix Universal (Thermo Fisher P/N 11762100) kit, using only forward and reverse amplification primers; alternatively, the Kapa Probe Force kit (Kapa Biosystems P/N KK4301) can be used with amplification primers and a TaqMan probe containing a FAM dye label at the 5' end, an internal ZEN quencher, and a minor groove binder and fluorescent quencher at the 3' end (Integrated DNA Technologies).

Quantitative polymerase chain reaction (qPCR) is a method of quantifying, in real time, the amplification of one or more nucleic acid sequences. The real time quantification of the PCR assay permits determination of the quantity of nucleic acids being generated by the PCR amplification steps by comparing the amplifying nucleic acids of interest and an appropriate control nucleic acid sequence, which may act as a calibration standard.

TaqMan probes are often utilized in qPCR assays that require an increased specificity for quantifying target nucleic acid sequences. TaqMan probes comprise an oligonucleotide probe with a fluorophore attached to the 5' end and a quencher attached to the 3' end of the probe. When the TaqMan probes remain as is with the 5' and 3' ends of the probe in close contact with each other, the quencher prevents fluorescent signal transmission from the fluorophore. TaqMan probes are designed to anneal within a nucleic acid region amplified by a specific set of primers. As the Taq polymerase extends the primer and synthesizes the nascent strand, the 5' to 3' exonuclease activity of the Taq polymerase degrades the probe that annealed to the template. This probe degradation releases the fluorophore, thus breaking the close proximity to the quencher and allowing fluorescence of the fluorophore. Fluorescence detected in the qPCR assay is directly proportional to the fluorophore released and the amount of DNA template present in the reaction.

The features of qPCR allow the practitioner to eliminate the labor-intensive post-amplification step of gel electrophoresis preparation, which is generally required for observation of the amplified products of traditional PCR assays. The benefits of qPCR over conventional PCR are considerable, and include increased speed, ease of use, reproducibility, and quantitative ability.

Microbes

As described herein, in some aspects, the recombinant microorganisms are prokaryotic microorganism. In some aspects, the prokaryotic microorganisms are bacteria. "Bacteria", or "eubacteria", refers to a domain of prokaryotic organisms. Bacteria include at least eleven distinct groups as follows: (1) Gram-positive (gram+) bacteria, of which there are two major subdivisions: (1) high G+C group (Actinomycetes, Mycobacteria, *Micrococcus*, others) (2) low G+C group (*Bacillus, Clostridia, Lactobacillus*, Staphylococci, Streptococci, Mycoplasmas); (2) Proteobacteria, e.g., Purple photosynthetic+non-photosynthetic Gram-negative bacteria (includes most "common" Gram-negative bacteria); (3) Cyanobacteria, e.g., oxygenic phototrophs; (4) Spirochetes and related species; (5) Planctomyces; (6) *Bacteroides,* Flavobacteria; (7) *Chlamydia*; (8) Green sulfur bacteria; (9) Green non-sulfur bacteria (also anaerobic phototrophs); (10) Radioresistant micrococci and relatives; (11) *Thermotoga* and Thermosipho thermophiles.

"Gram-negative bacteria" include cocci, nonenteric rods, and enteric rods. The genera of Gram-negative bacteria include, for example, *Neisseria, Spirillum, Pasteurella, Brucella, Yersinia, Francisella, Haemophilus, Bordetella, Escherichia, Salmonella, Shigella, Klebsiella, Proteus, Vibrio, Pseudomonas, Bacteroides, Acetobacter, Aerobacter, Agrobacterium, Azotobacter, Spirilla, Serratia, Vibrio, Rhizobium, Chlamydia, Rickettsia, Treponema,* and *Fusobacterium*.

"Gram positive bacteria" include cocci, nonsporulating rods, and sporulating rods. The genera of gram positive bacteria include, for example, *Actinomyces, Bacillus, Clostridium, Corynebacterium, Erysipelothrix, Lactobacillus, Listeria, Mycobacterium, Myxococcus, Nocardia, Staphylococcus, Streptococcus,* and *Streptomyces*.

In some aspects, the microorganisms of the present disclosure are fungi or yeasts.

In some aspects, the recombinant microorganism is a eukaryotic microorganism. In some aspects, the eukaryotic microorganism is a yeast. In exemplary aspects, the yeast is a member of a genus selected from the group consisting of *Yarrowia, Candida, Saccharomyces, Pichia, Hansenula, Kluyveromyces, Issatchenkia, Zygosaccharomyces, Debaryomyces, Schizosaccharomyces, Pachysolen, Cryptococcus, Trichosporon, Rhodotorula,* and *Myxozyma*.

In some aspects, the recombinant microorganism is a prokaryotic microorganism. In exemplary aspects, the prokaryotic microorganism is a member of a genus selected from the group consisting of *Escherichia, Clostridium, Zymomonas, Salmonella, Rhodococcus, Pseudomonas, Bacillus, Lactobacillus, Enterococcus, Alcaligenes, Klebsiella, Paenibacillus, Arthrobacter, Corynebacterium,* and *Brevibacterium*.

In some aspects, microorganism for use in the methods of the present disclosure can be selected from the group consisting of *Yarrowia, Candida, Saccharomyces, Pichia, Hansenula, Kluyveromyces, Issatchenkia, Zygosaccharomyces, Debaryomyces, Schizosaccharomyces, Pachysolen, Cryptococcus, Trichosporon, Rhodotorula, Myxozyma, Escherichia, Clostridium, Zymomonas, Salmonella, Rhodococcus, Pseudomonas, Bacillus, Lactobacillus, Enterococcus, Alcaligenes, Klebsiella, Paenibacillus, Arthrobacter, Corynebacterium,* and *Brevibacterium*.

In some aspects, a microbe resulting from the methods described herein may be a species selected from any of the following genera: *Neisseria, Spirillum, Pasteurella, Brucella, Yersinia, Francisella, Haemophilus, Bordetella, Escherichia, Salmonella, Shigella, Klebsiella, Proteus, Vibrio, Pseudomonas, Bacteroides, Acetobacter, Aerobacter, Agrobacterium, Azotobacter, Spirilla, Serratia, Vibrio, Rhizobium, Chlamydia, Rickettsia, Treponema, Fusobacterium, Actinomyces, Bacillus, Clostridium, Corynebacterium, Erysipelothrix, Lactobacillus, Listeria, Mycobacterium, Myxococcus, Nocardia, Staphylococcus, Streptococcus, Streptomyces, Saccharomyces, Pichia,* and *Aspergillus*.

In some aspects, microorganisms for use in the methods of the present disclosure include *Clostridium* sp., *Clostridium ljungdahlii, Clostridium autoethanogenum, Clostridium ragsdalei, Eubacterium limosum, Butyribacterium methylotrophicum, Moorella thermoacetica, Clostridium aceticum, Acetobacterium woodii, Alkalibaculum bacchii, Clostridium drakei, Clostridium carboxidivorans, Clostridium formicoaceticum, Clostridium scatologenes, Moorella thermoautotrophica, Acetonema longum, Blautia producta, Clostridium glycolicum, Clostridium magnum, Clostridium mayombei, Clostridium methoxybenzovorans, Clostridium acetobutylicum, Clostridium beijerinckii, Candida krusei, Oxobacter pfennigii, Thermoanaerobacter kivui, Sporomusa ovata, Thermoacetogenium phaeum, Acetobacterium carbinolicum, Sporomusa termitida, Moorella glycerini, Eubacterium aggregans, Treponema azotonutricium, Escherichia coli, Saccharomyces cerevisiae, Pseudomonas putida, Bacillus* sp, *Corynebacterium* sp., *Yarrowia lipolytica, Scheffersomyces stipitis,* and *Terrisporobacter glycolicus*. In some aspects, the recombinant microorganisms are derived from a parental microorganism selected from any one of the microorganisms disclosed herein.

In some aspects, yeast can be cultivated more rapidly and at a higher density than bacteria, and does not require an aseptic environment in the commercial/industrial setting. In some aspects, yeast cells can be more easily separated from the culture medium than can bacteria, simplifying the process for product extraction and purification.

In some aspects, the microorganism(s) used in the methods of the present disclosure include yeasts selected from genus *Saccharomyces, Candida, Ashbya, Dekkera, Pichia (Hansenula), Debaryomyces, Clavispora, Lodderomyces, Yarrowia, Zigosaccharomyces, Schizosaccharomyces, Torulaspora, Kluyveromyces, Brettanomycces, Cryptococcus,* or *Malassezia.*

In some aspects, the yeast may be a Crabtree-positive yeast selected from genus *Saccharomyces, Dekkera, Schizosaccharomyces, Kluyveromyces, Torulaspora Zigosaccharomyces,* or *Brettanomycces.*

In some aspects, the yeast may be selected from *Saccharomyces cerevisiae, Saccharomyces boulardii, Saccharomyces douglasii, Saccharomyces bayanus, Zigosaccharomyces bailii, Schizosaccharomyces pombe, Dekkera brucelensis, Dekkera intermedia, Brettanomycces custersii, Brettanomycces intermedius, Kluyveromyces themotolerens, Torulaspora globosa,* and *Torulaspora glabrata.*

In some aspects, the yeast may be from genus *Saccharomyces.* In some aspects, the yeast may be *Saccharomyces cerevisiae.*

In some aspects, a recombinant yeast of the present disclosure is able to decarboxylate oxaloacetate into malonate semialdehyde due to the insertion of at least one nucleic acid sequence or gene described herein. In some aspects, a recombinant yeast of the present disclosure is further able to co-produce one or more 3-HP and acetyl-CoA derivatives. In some aspects the malonate semialdehyde is the substrate for the co-production of the one or more 3-HP and acetyl-CoA derivatives.

The term "recombinant microorganism" and "recombinant host cell" are used interchangeably herein and refer to microorganisms that have been genetically modified to express or to overexpress endogenous enzymes, to express heterologous enzymes, such as those included in a vector, in an integration construct, or which have an alteration in expression of an endogenous gene. By "alteration" it is meant that the expression of the gene, or level of a RNA molecule or equivalent RNA molecules encoding one or more polypeptides or polypeptide subunits, or activity of one or more polypeptides or polypeptide subunits is up regulated or down regulated, such that expression level, or activity is greater than or less than that observed in the absence of the alteration. For example, the term "alter" can mean "inhibit," but the use of the word "alter" is not limited to this definition. It is understood that the terms "recombinant microorganism" and "recombinant host cell" refer not only to the particular recombinant microorganism but also to the progeny or potential progeny of such a microorganism. Because certain modifications may occur in succeeding generations due to either mutation or environmental influences, such progeny may not, in fact, be identical to the parent cell, but are still included within the scope of the term as used herein.

Culture Conditions

Culturing of the microorganisms used in the methods of the disclosure may be conducted using any number of processes known in the art for culturing and fermenting substrates using the microorganisms of the present disclosure.

The fermentation may be carried out in any suitable bioreactor, such as Continuous Stirred Tank Bioreactor, Bubble Column Bioreactor, Airlift Bioreactor, Fluidized Bed Bioreactor, Packed Bed Bioreactor, Photo-Bioreactor, Immobilized Cell Reactor, Trickle Bed Reactor, Moving Bed Biofilm Reactor, Bubble Column, Gas Lift Fermenter, Membrane Reactors such as Hollow Fiber Membrane Bioreactor. In some aspects, the bioreactor comprises a first, growth reactor in which the microorganisms are cultured, and a second, fermentation reactor, to which fermentation broth from the growth reactor is fed and in which most of the fermentation product is produced. In some aspects, the bioreactor simultaneously accomplishes the culturing of microorganism and the producing the fermentation product from carbon sources such substrates and/or feedstocks provided.

In some aspects, the present disclosure relates to the use of a recombinant microbe, for the production of (1) malonate semialdehyde, one of its salts, or a malonate semialdehyde derivative; (2) 3-HP, one of its salts, or a 3-HP derivative; and (3) acetyl-CoA, one of its salts, or a acetyl-CoA derivative. In some aspects, the recombinant microorganism is a yeast.

In some aspects, the present disclosure further relates to a method for producing (1) malonate semialdehyde, one of its salts, or a malonate semialdehyde derivative; (2) 3-HP, one of its salts, or a 3-HP derivative; and (3) acetyl-CoA, one of its salts, or a acetyl-CoA derivative; the method comprising the steps of:

(a) culturing a recombinant microorganism described herein in a culture medium; and (b) recovering the (2) 3-HP, one of its salts, or a 3-HP derivative; and (3) acetyl-CoA, one of its salts, or an acetyl-CoA derivative from the culture medium. In some aspects, the recombinant microorganism is a yeast.

In some aspects, microorganisms described herein are grown at a temperature in the range of about 20° C. to about 37° C., preferably at a temperature ranging from 27 to 34° C., in an appropriate culture medium.

In some aspects, the recombinant yeast of the present disclosure belongs to the *S. cerevisiae* species, the temperature may range from 27 to 34° C., in an appropriate culture medium.

In some aspects, suitable growth media for yeast are common commercially prepared media such as broth that includes yeast nitrogen base, ammonium sulfate, and dextrose as the carbon/energy source) or YPD Medium, a blend of peptone, yeast extract, and dextrose in optimal proportions for growing most. In some aspects, other defined or synthetic growth media may also be used and the appropriate medium for growth of the particular microorganism will be known by one skilled in the art of microbiology or fermentation science.

Examples of culture media for a recombinant yeast of the present disclosure are described by D. Burke et al., Methods in yeast Genetics—A cold spring harbor laboratory course Manual (2000).

In some aspects, suitable pH ranges for the fermentation may be between pH 3.0 to pH 7.5, where pH 4.5 to pH 6.5 is preferred as the initial condition.

In some aspects, fermentations may be performed under aerobic conditions, microaerobic conditions, or anaerobic conditions.

In some aspects, the amount of product(s) in the fermentation medium can be determined using a number of methods known in the art, for example, high performance liquid chromatography (HPLC) or gas chromatography (GC).

In some aspects, the present process may employ a batch method of fermentation. A classical batch fermentation is a closed system where the composition of the medium is set at the beginning of the fermentation and not subject to artificial alterations during the fermentation. Thus, at the beginning of the fermentation, the medium is inoculated with the desired organism or organisms, and fermentation is permitted to occur without adding anything to the system. Typically, however, a "batch" fermentation is batch with respect to the addition of carbon source and attempts are often made at controlling factors such as temperature, pH and oxygen concentration. In batch systems, the metabolite and biomass compositions of the system change constantly up to the time when the fermentation is stopped. Within batch cultures cells progress through a static lag phase to a high growth log phase and finally to a stationary phase where growth rate is diminished or halted. If untreated, cells in the stationary phase will eventually die. Cells in log phase generally are responsible for the bulk of production of end product or intermediate.

In some aspects, a fed-batch system may also be used. A fed-batch system is similar to a typical batch system with the exception that the carbon source substrate is added in increments as the fermentation progresses. Fed-batch systems are useful when catabolite repression (e.g. glucose repression) is apt to inhibit the metabolism of the cells and where it is desirable to have limited amounts of substrate in the media. Measurement of the actual substrate concentration in fed-batch systems is difficult and is therefore estimated on the basis of the changes of measurable factors such as pH, dissolved oxygen and the partial pressure of waste gases such as $CO_2$.

A variety of fermentations are described in Sunderland et al., (1992), herein incorporated by reference. In some aspects, the fermentation is performed in batch mode it is contemplated that the method would be adaptable to continuous fermentation.

Continuous fermentation is an open system where a defined fermentation medium is added continuously to a bioreactor and an equal amount of conditioned media is removed simultaneously for processing. Continuous fermentation generally maintains the cultures at a constant high density where cells are primarily in log phase growth.

Continuous fermentation allows for the modulation of one factor or any number of factors that affect cell growth or end product concentration. For example, one method will maintain a limiting nutrient such as the carbon source or nitrogen level at a fixed rate and allow all other parameters to vary. In other systems a number of factors affecting growth can be altered continuously while the cell concentration, measured by media turbidity, is kept constant. Continuous systems strive to maintain steady state growth conditions and thus the cell loss due to the medium being drawn off must be balanced against the cell growth rate in the fermentation. Methods of modulating nutrients and growth factors for continuous fermentation processes as well as techniques for maximizing the rate of product formation are well known in the art of industrial microbiology.

In some aspects, the methods may be practiced using either batch, fed-batch, or continuous processes and that any known mode of fermentation would be suitable. Additionally, it is contemplated that cells may be immobilized on a substrate as whole cell catalysts and subjected to fermentation conditions for production.

In order to still improve the production of (1) malonate semialdehyde, (2) 3-HP, and acetyl-CoA; one of their salts, or derivatives thereof, a particular embodiment may consist of culturing the recombinant yeast cells in an appropriate culture medium, such as above-mentioned, wherein the said culture medium comprises an optimal amount of carbon source, especially glucose.

In some aspects, the cells are cultured in such an optimal culture medium during only a part of the whole culture duration. In some aspects, the yeast cells are incubated in the said optimal culture medium 10 hours or more after initiation of the culture, which encompasses 11, 12, 13, 14, 15 or 16 hours or more after initiation of the culture.

In some aspects, the cells are cultured in such an optimal culture medium during a time period ranging from 5 hours to 15 hours, which includes from 6 hours to 10 hours, e.g. 8 hours after initiation of the culture.

In some aspects, the carbon source comprised in said optimal culture medium consists of glucose. In preferred embodiments, the said optimal culture medium comprises 12% w/w or more glucose, including 15% w/w or more glucose. In preferred embodiments, the said optimal culture medium comprises at most 40% w/w glucose, which includes at most 35% w/w glucose.

In some aspects, a method for producing (1) malonate semialdehyde, (2) 3-HP, and (3) acetyl-CoA; one of their salts, or derivatives thereof may further comprise, between steps (a) and (c), an intermediate step (b) consisting of cultivating the yeast cells in the said optimal culture medium.

Product Isolation/Purification

In some aspects, the method of producing (1) malonate semialdehyde, one of its salts, or a malonate semialdehyde derivative; (2) 3-HP, one of its salts, or a 3-HP derivative; and (3) acetyl-CoA, one of its salts, or a acetyl-CoA derivative comprises one or more steps of isolation of at least the (2) 3-HP, one of its salts, or a 3-HP derivative; and (3) acetyl-CoA, one of its salts, or a acetyl-CoA derivative. In some aspects, the method comprises, in a first reaction, producing and isolating/purifying malonate semialdehyde, one of its salts, or a malonate semialdehyde derivative in one fermentation to add the purified/isolated product to a second reaction (fermentation/bioreactor) to drive the production of (2) 3-HP, one of its salts, or a 3-HP derivative; and (3) acetyl-CoA, one of its salts, or a acetyl-CoA derivative.

In some aspects, recovering one or more of (1) malonate semialdehyde, one of its salts, or a malonate semialdehyde derivative; (2) 3-HP, one of its salts, or a 3-HP derivative; and (3) acetyl-CoA, one of its salts, or a acetyl-CoA derivative from a culture medium may be achieved by a number of techniques, including, but not limited to, distillation, gas-stripping, pervaporation, selective precipitation, or liquid extraction.

In some aspects, the recombinant microorganism exports (1) malonate semialdehyde, one of its salts, or a malonate semialdehyde derivative; (2) 3-HP, one of its salts, or a 3-HP derivative; and (3) acetyl-CoA, one of its salts, or a acetyl-CoA derivative into the culture medium, thus simplifying the culture process.

In some aspects, the products are referred to as one or more of (1) malonate semialdehyde, one of its salts, or a malonate semialdehyde derivative; (2) 3-HP, one of its salts, or a 3-HP derivative; and (3) acetyl-CoA, one of its salts, or a acetyl-CoA derivative.

In some aspects, the products are collected from the medium by distillation. In some aspects, distillation may involve a component different from the culture medium in order to facilitate the isolation of the products by forming azeotrope and notably with water. This component is an organic solvent such as cyclohexane, pentane, butanol, benzene, toluene, tricholoethylene, octane, diethylether, or a mixture thereof.

In some aspects, gas stripping is achieved with a stripping gas chosen among helium, argon, carbon dioxide, hydrogen, nitrogen, or mixtures thereof. In some aspects, liquid extraction is achieved with an organic solvent as the hydrophobic phase such as pentane, hexane, or dodecane.

In some aspects, once a desired number of microbes have been achieved, the spent media is subjected to a process for isolating the products. In some aspects, once a desired density of microbes has been achieved, the spent media is subject to a process for isolating the products. In some aspects, the microbes are lysed and the cellular debris is pelleted out of solution in a centrifuge. In some aspects, the products collected from the cell pellet fraction or the liquid fraction with the aid of a solvent extraction process or a gradient ultra-centrifugation process.

Microbial Compositions

In some aspects, the microbes of the disclosure are combined into microbial compositions.

In some aspects, the microbial compositions of the present disclosure are solid. Where solid compositions are used, it may be desired to include one or more carrier materials including, but not limited to: mineral earths such as silicas, talc, kaolin, limestone, chalk, clay, dolomite, diatomaceous earth; calcium sulfate; magnesium sulfate; magnesium oxide; zeolites, calcium carbonate; magnesium carbonate; trehalose; chitosan; shellac; albumins; starch; skim milk powder; sweet whey powder; maltodextrin; lactose; inulin; dextrose; and products of vegetable origin such as cereal meals, tree bark meal, wood meal, and nutshell meal.

In some aspects, the microbial compositions of the present disclosure are liquid. In further aspects, the liquid comprises a solvent that may include water or an alcohol or a saline or carbohydrate solution. In some aspects, the microbial compositions of the present disclosure include binders such as polymers, carboxymethylcellulose, starch, polyvinyl alcohol, and the like.

In some aspects, microbial compositions of the present disclosure comprise saccharides (e.g., monosaccharides, disaccharides, trisaccharides, polysaccharides, oligosaccharides, and the like), polymeric saccharides, lipids, polymeric lipids, lipopolysaccharides, proteins, polymeric proteins, lipoproteins, nucleic acids, nucleic acid polymers, silica, inorganic salts and combinations thereof. In further aspect, microbial compositions comprise polymers of agar, agarose, gelrite, gellan gum, and the like. In some aspects, microbial compositions comprise plastic capsules, emulsions (e.g., water and oil), membranes, and artificial membranes. In some aspects, emulsions or linked polymer solutions may comprise microbial compositions of the present disclosure. See Harel and Bennett (U.S. Pat. No. 8,460,726 B2).

In some aspects, microbial compositions of the present disclosure occur in a solid form (e.g., dispersed lyophilized spores) or a liquid form (microbes interspersed in a storage medium). In some aspects, microbial compositions of the present disclosure are added in dry form to a liquid to form a suspension immediately prior to use.

In some aspects, the microbial composition of the present disclosure possesses a water activity (aw) of less than 0.750, 0.700, 0.650, 0.600, 0.550, 0.500, 0.475, 0.450, 0.425, 0.400, 0.375, 0.350, 0.325, 0.300, 0.275, 0.250, 0.225, 0.200, 0.190, 0.180, 0.170, 0.160, 0.150, 0.140, 0.130, 0.120, 0.110, 0.100, 0.095, 0.090, 0.085, 0.080, 0.075, 0.070, 0.065, 0.060, 0.055, 0.050, 0.045, 0.040, 0.035, 0.030, 0.025, 0.020, 0.015, 0.010, or 0.005.

In some aspects, the microbial composition of the present disclosure possesses a water activity (aw) of less than about 0.750, about 0.700, about 0.650, about 0.600, about 0.550, about 0.500, about 0.475, about 0.450, about 0.425, about 0.400, about 0.375, about 0.350, about 0.325, about 0.300, about 0.275, about 0.250, about 0.225, about 0.200, about 0.190, about 0.180, about 0.170, about 0.160, about 0.150, about 0.140, about 0.130, about 0.120, about 0.110, about 0.100, about 0.095, about 0.090, about 0.085, about 0.080, about 0.075, about 0.070, about 0.065, about 0.060, about 0.055, about 0.050, about 0.045, about 0.040, about 0.035, about 0.030, about 0.025, about 0.020, about 0.015, about 0.010, or about 0.005.

The water activity values are determined by the method of Saturated Aqueous Solutions (Multon, "Techniques d'Analyse E De Controle Dans Les Industries Agroalimentaires" APRIA (1981)) or by direct measurement using a viable Robotronic BT hygrometer or other hygrometer or hygroscope.

Feedstock

In some aspects, the disclosure is drawn to a method of producing and/or recovering/isolating a 3-HP and acetyl-CoA derivative. The recovery/collection/isolation can be by methods known in the art, such as distillation, membrane-based separation gas stripping, solvent extraction, and expanded bed adsorption.

In some aspects, the feedstock comprises a carbon source. In some aspects, the carbon source may be selected from sugars, glycerol, alcohols, organic acids, alkanes, fatty acids, lignocellulose, proteins, carbon dioxide, and carbon monoxide. In one aspect, the carbon source is a sugar. In one aspect, the sugar is glucose or oligomers of glucose thereof. In one aspect, the oligomers of glucose are selected from fructose, sucrose, starch, cellobiose, maltose, lactose and cellulose. In one aspect, the sugar is a five carbon sugar. In one aspect, the sugar is a six carbon sugar. In some aspects, the feedstock comprises one or more five carbon sugars and/or one or more six carbon sugars. In some aspects, the feedstock comprises one or more of xylose, glucose, arabinose, galactose, maltose, fructose, mannose, sucrose, and/or combinations thereof. In some aspects, the feedstock comprises one or more of xylose and/or glucose. In some aspects, the feedstock comprises one or more of arabinose, galactose, maltose, fructose, mannose, sucrose, and/or combinations thereof.

In some aspects, the microbes utilize one or more five carbon sugars (pentoses) and/or one or more six carbon sugars (hexoses). In some aspects, the microbes utilize one or more of xylose and/or glucose. In some aspects, the microbes utilize one or more of arabinose, galactose, maltose, fructose, mannose, sucrose, and/or combinations thereof. In some aspects, the microbes utilize one or more of xylose, glucose, arabinose, galactose, maltose, fructose, mannose, sucrose, and/or combinations thereof. The carbon source(s) utilized may encompass a wide variety of carbon-containing substrates and will generally only be limited by the choice of microorganism.

In some aspects, hexoses may be selected from D-allose, D-altrose, D-glucose, D-mannose, D-gulose, D-idose, D-galactose, D-talose, D-tagtose, D-sorbose, D-fructose, D-psicose, and other hexoses known in the art. In some aspects, pentoses may be selected from D-xylose, D-ribose, D-arabinose, D-lyxose, D-xylulose, D-ribulose, and other pentoses known in the art. In some aspects, the hexoses and pentoses may be selected from the levorotary or dextrorotary enantiomer of any of the hexoses and pentoses disclosed herein.

In some aspects, a fermentation is generally conducted in fermenters/bioreactors with an appropriate culture medium adapted to the microorganism(s) being cultivated. In some aspects, the medium contains at least one simple carbon source. In some aspects, the medium contains additional substrates.

In some aspects, additional substrates may include any one or more of the carbon sources described herein; polysaccharides such as start or cellulose, or mixtures thereof unpurified mixtures from renewable feedstocks such as cheese whey permeate, corn steep liquor, sugar beet molasses, and barley malt.

In some aspects, the media may further contain suitable minerals, salts, cofactors, buffers, and other components suitable for the growth of the cultures and promotion of the enzymatic pathway necessary for the production of the desired product.

In some aspects, total amount of C5 and/or C6 carbohydrates fed to a bioreactor/growth medium during the growth phase is at least 5 kg carbohydrate/m3, at least 10 kg carbohydrate/m3, at least 20 kg carbohydrate/m3, at least 30 kg carbohydrate/m3, at least 40 kg carbohydrate/m3, at least 50 kg carbohydrate/m3, at least 60 kg carbohydrate/m3, at least 70 kg carbohydrate/m3, at least 80 kg carbohydrate/m3, at least 90 kg carbohydrate/m3, at least 100 kg carbohydrate/m3, at least 150 kg carbohydrate/m3, at least 200 kg carbohydrate/m3, at least 250 kg carbohydrate/m3, at least 300 kg carbohydrate/m3, at least 400 kg carbohydrate/m3 at least 500 kg carbohydrate/m3, at least 600 kg carbohydrate/m3, at least 700 kg carbohydrate/m3, up to 800 kg carbohydrate/m3. In some aspects, total amount of C5 and/or C6 carbohydrates fed to the bioreactor/growth medium during the growth phase ranges from about 10 kg carbohydrate/m3 up to 500 kg carbohydrate/m3.

In some aspects, time required for the growth phase varies between 1 to 200 hours. In further aspects, the time of the growth phase is between 5 to 50 hours. The time is dependent on carbohydrate feeds and/or feedstocks.

As used herein, an "appropriate culture medium" means a medium, such as a sterile liquid medium, comprising nutrients essential or beneficial to the maintenance and/or growth of the microbial cells such as carbon sources or carbon substrate, nitrogen sources, for example, peptone, yeast extracts, meat extracts, malt extracts, urea, ammonium sulfate, ammonium chloride, ammonium nitrate, and ammonium phosphate; phosphorus sources, for example, monopotassium phosphate or dipotassium phosphate; trace elements (e.g., metal salts), for example magnesium salts, cobalt salts, and/or manganese salts; as well as growth factors such as amino acids, vitamins, growth promoters, and the like. The term "carbon source" or "carbon substrate" or "source of carbon" according to the present disclosure denotes any source of carbon that can be used by those skilled in the art to support the normal growth of a microorganism, including hexoses (such as glucose, galactose or lactose), pentoses, monosaccharides, oligosaccharides, disaccharides (such as sucrose, cellobiose or maltose), molasses, starch or its derivatives, cellulose, hemicelluloses and combinations thereof.

In some aspects, the total amount of C5 and/or C6 carbohydrates fed to the bioreactor/growth medium during the production phase is at least 50 kg carbohydrate/m3, at least 60 kg carbohydrate/m3, at least 70 kg carbohydrate/m3, at least 80 kg carbohydrate/m3, at least 90 kg carbohydrate/m3, at least 100 kg carbohydrate/m3, at least 150 kg carbohydrate/m3, at least 200 kg carbohydrate/m3, at least 250 kg carbohydrate/m3, at least 300 kg carbohydrate/m3, at least 400 kg carbohydrate/m3, at least 500 kg carbohydrate/m3, at least 600 kg carbohydrate/m3, at least 700 kg carbohydrate/m3, at least 800 kg carbohydrate/m3, at least 900 kg carbohydrate/m3 up to 1000 kg carbohydrate/m3. In some aspects, total amount of C5 and/or C6 carbohydrates fed to the bioreactor/growth medium during the production phase ranges from about 100 kg carbohydrate/m3 up to 800 kg carbohydrate/m3.

In some aspects, time required for the production phase varies between 5 to 500 hours. In further aspects, the time for the production phase varies from 10 to 300 hours for batch and fed-batch operations. In other aspects, the time of the production phase is up to 300 hours with continuous fermentation.

In some aspects, the total amount of C5 and/or C6 carbohydrates fed to the bioreactor/growth medium for one-phase process is at least 50 kg carbohydrate/m3, at least 60 kg carbohydrate/m3, at least 70 kg carbohydrate/m3, at least 80 kg carbohydrate/m3, at least 90 kg carbohydrate/m3, at least 100 kg carbohydrate/m3, at least 150 kg carbohydrate/m3, at least 200 kg carbohydrate/m3, at least 250 kg carbohydrate/m3, at least 300 kg carbohydrate/m3, at least 400 kg carbohydrate/m3, at least 500 kg carbohydrate/m3, at least 600 kg carbohydrate/m3, at least 700 kg carbohydrate/m3, at least 800 kg carbohydrate/m3, at least 900 kg carbohydrate/m3 up to 1000 kg carbohydrate/m3. In some aspects, total amount of C5 and/or C6 carbohydrates fed to the bioreactor/growth medium during the production phase ranges from about 100 kg carbohydrate/m3 up to 800 kg carbohydrate/m3.

In some aspects, time required for the production phase in the one-phase process varies between 5 to 500 hours. In further aspects, the time required for production phase in the one-phase process varies between 5 to 300 hours.

In some aspects, the one-phase or multi-phase production processes take about 5, about 10, about 25, about 50, about 75, about 100, about 125, about 150, about 175, about 200, about 225, about 250, about 275, about 300 about 325, about 350, about 375, about 400, about 425, about 450, about 475, or about 500 hours.

In some aspects, the one-phase or multi-phase production processes take 5, 10, 25, 50, 75, 100, 125, 150, 175, 200, 225, 250, 275, 300 325, 350, 375, 400, 425, 450, 475, or 500 hours.

EXAMPLES

Example 1: Creating Recombinant *S. cerevisiae* Strain to Produce Malonate Semialdehyde Recombinant *Saccharomyces cerevisiae* strains were constructed from standard strains using standard yeast molecular genetics procedure (Methods in yeast Genetics—A cold spring harbor laboratory course Manual (2000) by D. Burke, D. Dawson, T. Stearns CSHL Press).

The following genes were integrated in recombinant yeast using the ability of yeast to efficiently recombine free DNA ends sharing sequence homology.

More particularly, the coding sequences to be cloned were artificially synthetized. For heterologous sequences (non-yeast), the nucleic sequences were modified in order to obtain a synonymous coding sequence using the yeast codon usage. Using restriction enzyme and classical cloning technology, each synthetic sequence was cloned in between a transcription promoter and a transcription terminator. Each promoter sequence is preceded by a 50 to 200 nucleotides sequence homologous to the sequence of the terminator of the upstream gene. Similarly, the terminator of each gene (a gene comprising the promoter-coding sequence-terminator) is followed by sequences homologous to the gene immediately following. So that each of the unit to be integrated have a 50-200 nucleotide overlap with both the unit upstream and the unit downstream. For the first unit, the promoter is preceded by 50-200 nucleotides homologous to the yeast chromosome nucleotide for the locus in which it will be integrated. Similarly, for the last unit, the terminator is followed by 50-200 nucleotides homologous to the yeast chromosome nucleotide for the locus in which it will be integrated.

Each unit are then PCR amplified from the plasmids constructs, yielding X unit of linear DNA having overlapping sequences. At least one of this gene is an auxotrophic marker, in order to select for recombination event. All the linear fragments are transformed in the yeast at once, and recombinant yeast are selected for the auxotrophy related to the marker used. The integrity of the sequence is then verified by PCR and sequencing. Aspects of synthetic biology utilized described in Tian J. et al., Mol. Biosyst. 2009; 5(7):714-22.

Example 2: Method of Modifying a Yeast

The recombinant yeasts are mutant yeasts (Δfms1) which are impaired for β-alanine synthesis. As a consequence, the yeast is auxotroph for pantothenate and cannot grow on a medium deprived of pantothenate. In the same yeasts is expressed PYD4 from *Lachancea kluyveri*, a gene which encodes a β-alanine aminotransferase activity absent from *Saccharomyces cerevisiae*.

Figure 13:
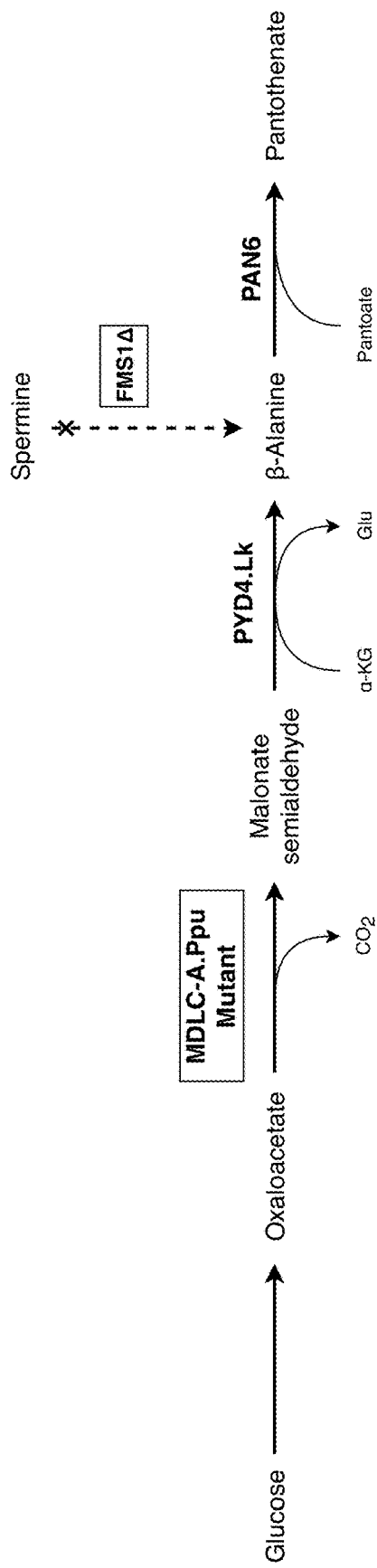
FIG. 13 depicts a pathway and yeast genotype relating to the mutants relating to Example 2.

This enzyme is able to transform Malonic semialdehyde into β-alanine (Andersen et al. 2007 FEBS Journal 274, 1804-1817). This yeast then lacks an activity able to produce malonyl semialdehyde to be able to grow in absence of pantothenate in the medium. See FIG. 13.

This yeast is still unable to grow on a pantothenate free medium upon expression of the benzoylformate decarboxylase from *P. putida*. Indeed, benzoylformate decarboxylase is not able to catalyze the transformation of oxaloacetate into malonate semialdehyde.

The following enzymes have been tested in vivo, in separate yeasts.

```
Enzyme No 1:
                                                      (SEQ ID NO: 2)
MASVHGTTYELLRRQGIDTVFGNPGSNELPFLKDFPEDFRYILALQEACVVGIA

DGYAQASRKPAFINLHSAAGTGNAMGALSNAWNSHSPLIVTAGQQTRAMIGVEARLTN

VDAANLPRPLVKWSYEPASAAEVPHAMSRAIHMASMAPQGPVYLSVPYDDWDKDADP

QSHHLFDRHVSSSVRLNDQDLDILVKALNSASNPAIVLGPDVDAANANADCVMLAERL

KAPVWVAPSAPRCPFPTRHPCFRGLMPAGIAAISQLLEGHDVVLVIGAPVFRYHQYDPG

QYLKPGTRLISVTCDPLEAARAPMGDAIVADIGAMASALANLVEESSRQLPTAAPEPAK

VDQDAGRLHPETVEDTLNDMAPENAIYLNESTSTTAQMWQRLNMRNPGSYYFCAAGG

LGFALPAAIGVQLAEPERQVIAVIGDGSANYSISALWTAAQYNIPTIFVIMNNGTYGALR

WFAGVLEAENVPGLDVPGIDFRALAKGYGVQALKADNLEQLKGSLQEALSAKGPVLIE

VSTVSPVK

Enzyme No 2:
                                                      (SEQ ID NO: 3)
MASVHGTTYELLRRQGIDTVEGNPGSNELPFLKDEPEDFRYILALQEACVVGIA

DGYAQASRKPAFINLHSAAGTGNAMGALSNAWNSHSPLIVTAGQQTRAMIGVEARLTN

VDAANLPRPLVKWSYEPASAAEVPHAMSRAIHMASMAPQGPVYLSVPYDDWDKDADP

QSHHLFDRHVSSSVRLNDQDLDILVKALNSASNPAIVLGPDVDAANANADCVMLAERL

KAPVWVAPSAPRCPFPTRHPCFRGLMPAGIAAISQLLEGHDVVLVIGAPVFRYHQYDPG

QYLKPGTRLISVTCDPLEAARAPMGDAIVADIGAMASALANLVEESSRQLPTAAPEPAK

VDQDAGRLHPETVFDTLNDMAPENAIYLNESTSTTAQMWQRLNMRNPGSYYNCAAGG

LGFALPAAIGVQLAEPERQVIAVIGDGSANYSISALWTAAQYNIPTIFVIMNNGTYGALR

WFAGVLEAENVPGLDVPGIDFRALAKGYGVQALKADNLEQLKGSLQEALSAKGPVLIE

VSTVSPVK

Enzyme No 3:
                                                      (SEQ ID NO: 4)
MASVHGTTYELLRRQGIDTVEGNPGSNELPFLKDEPEDFRYILALQEACVVGIA

DGYAQASRKPAFINLHSAAGTGNAMGALSNAWNSHSPLIVTAGQQTRAMIGVEAKLTN

VDAANLPRPLVKWSYEPASAAEVPHAMSRAIHMASMAPQGPVYLSVPYDDWDKDADP

QSHHLFDRHVSSSVRLNDQDLDILVKALNSASNPAIVLGPDVDAANANADCVMLAERL

KAPVWVAPSAPRCPFPTRHPCFRGLMPAGIAAISQLLEGHDVVLVIGAPVFRYHQYDPG

QYLKPGTRLISVTCDPLEAARAPMGDAIVADIGAMASALANLVEESSRQLPTAAPEPAK
```

```
VDQDAGRLHPETVFDTLNDMAPENAIYLNESTSTTAQMWQRLNMRNPGSYYNCAAGG

LGFALPAAIGVQLAEPERQVIAVIGDGSANYSISALWTAAQYNIPTIFVIMNNGTYGALR

WFAGVLEAENVPGLDVPGIDFRALAKGYGVQALKADNLEQLKGSLQEALSAKGPVLIE

VSTVSPVK

Enzyme No 4:
                                                    (SEQ ID NO: 5)
MASVHGTTYELLRRQGIDTVEGNPGSNELPFLKDEPEDFRYILALQEACVVGIA

DGYAQASRKPAFINLHSAAGTGNAMGALSNAWNSHSPLIVTAGQQTRAMIGVEARLTN

VDAANLPRPLVKWSYEPASAAEVPHAMSRAIHMASMAPQGPVYLSVPYDDWDKDADP

QSHHLFDRHVSSSVRLNDQDLDILVKALNSASNPAIVLGPDVDAANANADCVMLAERL

KAPVWVAPSAPRCPEPTRHPCFRGLMPAGIAAISQLLEGHDVVLVIGAPVERYHQYDPG

QYLKPGTRLISVTCDPLEAARAPMGDAIVADIGAMASALANLVEESSRQLPTAAPEPAK

VDQDAGRLHPETVEDTLNDMAPENAIYLNESTSTTAQMWQRLNMRNPGSYYNCAAGG

LGFALPAAIGVQLAEPERQVIAVIGDGSANYSISALWTAAQYNIPTIEVIMNNGTYGLLR

WFAGVLEAENVPGLDVPGIDFRALAKGYGVQALKADNLEQLKGSLQEALSAKGPVLIE

VSTVSPVK

Enzyme No 5:
                                                    (SEQ ID NO: 6)
MASVHGTTYELLRRQGIDTVEGNPGSNELPFLKDEPEDFRYILALQEACVVGIA

DGYAQASRKPAFINLHSAAGTGNAMGALSNAWNSHSPLIVTAGQQTRAMIGVEAVKT

NVDAANLPRPLVKWSYEPASAAEVPHAMSRAIRMASMAPQGPVYLSVPYDDWDKDA

DPQSHHLFDRHVSSSVRLNDQDLDILVKALNSASNPAIVLGPDVDAANANADCVMLAE

RLKAPVWVAPSAPRCPEPTRHPCFRGLMPAGIAAISQLLEGHDVVLVIGAPVERYHQYD

PGQYLKPGTRLISVTCDPLEAARAPMGDAIVADIGAMASALANLVEESSRQLPTAAPEP

AKVDQDAGRLHPETVEDTLNDMAPENAIYLNESTSTTAQMWQRLNMRNPGSYYNCAA

GGNGFALPAAIGVQLAEPERQVIAVIGDGSANYSISALWTAAQYNIPTIEVIMNNGTVGA

LRWFAGVLEAENVPGLDVPGIDFRALAKGYGVQALKADNLEQLKGSLQEALSAKGPVL

IEVSTVSPVK

Enzyme No 6:
                                                    (SEQ ID NO: 242)
MASVHGTTYELLRRQGIDTVEGNPGSNELPFLKDEPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPEPTRHPCFRGLMPAGIAAISQLLEGHDVVLVIGAPVERYHRYDPGQYLKPGTRLISVT

CDPLEAARAPMGDAIVADIGAMASALANLVEESSRQLPTAAPEPAKVDQDAGRLHPETVF

DTLNDMAPEDAIYLNESTSTTAQMWQRLNMRNPGSYYLCAAGGLGFALPAAIGVQLAEP

ERQVIAVIGDGSANYSISALWTAAQYNVPTIEVIMNNGTYGTLRWFAGVLEAENVPGLDV

PGIDFRALAKGYGVQALKADNLEQLKGSLQEALSAKGPVLIEVSTVSPVK

Enzyme No 7:
                                                    (SEQ ID NO: 243)
MASVHGTTYELLRRQGIDIVEGNPGSNELPFLKDEPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH
```

-continued

```
VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYRQYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLDMRNPGSYYFCAAGGLGFALPAAIGVQLAEP

GRQVIAVIGDGSANYSISALWTAAQYNIPTIFVIMNNGTYGLLRWSAGVLGAENVPGLDV

PGIDFRALAKGYGVQALKADNLEQLKGSLQEALSAKGPVLIEVSTVSPVK

Enzyme No 8:
                                                    (SEQ ID NO: 244)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYRQYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYFCAAGGLGFALPAAIGVQLAEP

ERQVIAVIGDGSANYSISALWTAAQYNIPTIFVIMNNGTYGGLRWFAGVLEAENVPGLDVP

GIDFRALAKGYGVQALKADNLEQLKGSLQEALSAKGPVLIEVSTVSPVK

Enzyme No 9:
                                                    (SEQ ID NO: 245)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYFCAAGGLGFALPAAIGVQLAEP

ERQVIAVIGDGSANYSISALWTAAQYNIPTIFVIMNNGTYGTLRWFAGVLEAENVPGLDVP

GIDFRALAKGYGVQALKADNLEQLKGSLQEALSAKGPVLIEVSTVSPVK

Enzyme No 10:
                                                    (SEQ ID NO: 246)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHQYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYACAAGGLGFALPAAIGVQLAEP

ERQVIAVIGDGSANYSISALWTAAQYNIPTIFVIMNNGTYGALRWFAGVLEAENVPGLDVP

GIDFRALAKGYGVQALKADNLEQLKGSLQEALSAKGPVLIEVSTVSPVK

Enzyme No 11:
                                                    (SEQ ID NO: 247)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA
```

-continued

```
PRCPFPTRHPCFRGLMPAGIAAISQLLEGHDVVLVIGAPVFRYHQYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYFCAAGGLGFALPAAIGVQLAEP

ERQVIAVIGDGSANYSISALWTAAQYNIPTIFVIMNNGTYGLLRWFAGVLEAENVPGLDVP

GIDFRALAKGYGVQALKADNLEQLKGSLQEALSAKGPVLIEVSTVSPVK

Enzyme No 12:
                                               (SEQ ID NO: 248)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYRQYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYFCAAGGLGFALPAAIGVQLAEP

ERQVIAVIGDGSANYSISALWTAAQYNIPTIFVIMNNGTYGALRWFAGVLEAENVPGLDVP

GIDFRALAKGYGVQALKADNLEQLKGSLQEALSAKGPVLIEVSTVSPVK

Enzyme No 13:
                                               (SEQ ID NO: 249)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYRQYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYFCAAGGLGFALPAAIGVQLAEP

ERQVIAVIGDGSANYSISALWTAAQYNIPTIFVIMNNGTYGTLRWFAGVLEAENVPGLDVP

GIDFRALAKGYGVQALKADNLEQLKGSLQEALSAKGPVLIEVSTVSPVK

Enzyme No 14:
                                               (SEQ ID NO: 250)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRC PFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYFCAAGGLGFALPAAIGVQLAEP

ERQVIAVIGDGSANYSISALWTAAQYNIPTIFVIMNNGTYGALRWFAGVLEAENVPGLDVP

GIDFRALAKGYGVQALKADNLEQLKGSLQEALSAKGPVLIEVSTVSPVK

Enzyme No 15:
                                               (SEQ ID NO: 251)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA
```

-continued

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYFCAAGGLGFALPAAIGVQLAEP

ERQVIAVIGDGSANYSISALWTAAQYNIPTIFVIMNNGTYGLLRWFAGVLEAENVPGLDVP

GIDFRALAKGYGVQALKADNLEQLKGSLQEALSAKGPVLIEVSTVSPVK

Enzyme No 16:
(SEQ ID NO: 252)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPEDAIYLNESTSTTAQMWQRLNMRNPGSYYLCAAGGLGFALPAAIGVQLAEP

ERQVIAVIGDGSANYSISALWTAAQYNVPTIFVIMNNGTYGLLRWFAGVLEAENVPGLDV

PGIDFRALAKGYGVQALKADNLEQLKGSLQEALSAKGPVLIEVSTVSPVK

Enzyme No 17:
(SEQ ID NO: 253)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPEDAIYLNESTSTTAQMWQRLNMRNPGSYYLCAAGGLGFALPAAIGVQLAEP

ERQVIAVIGDGSANYSISALWTAAQYNVPTIFVIMNNGTYGGLRWFAGVLEAENVPGLDV

PGIDFRALAKGYGVQALKADNLEQLKGSLQEALSAKGPVLIEVSTVSPVK

Enzyme No 18:
(SEQ ID NO: 254)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPEDAIYLNESTSTTAQMWQRLNMRNPGSYYLCAAGGLGFALPAAIGVQLAEP

ERQVIAVIGDGSANYSISALWTAAQYNVPTIFVIMNNGTYGTLRWSAGVLEAENVPGLDV

PGIDFRALAKGYGVQALKADNLEQLKGSLQEALSAKGPVLIEVSTVSPVK

Enzyme No 19:
(SEQ ID NO: 255)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

-continued

```
CDPLEAARAPMGDAIVADIGAMASALANLVEESSRQLPTAAPEPAKVDQDAGRLHPETVF

DTLNDMAPEDAIYLNESTSTTAQMWQRLNMRNPGSYYLCAAGGLGFALPAAIGVQLAEP

GRQVIAVIGDGSANYSISALWTAAQYNVPTIFVIMNNGTYGTLRWSAGVLGAENVPGLDV

PGIDFRALAKGYGVQALKADNLEQLKGSLQEALSAKGPVLIEVSTVSPVK

Enzyme No 20:
                                                    (SEQ ID NO: 256)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPEDAIYLNESTSTTAQMWQRLNMRNPGSYYLCAAGGLGFALPAAIGVQLAEP

GRQVIAVIGDGSANYSISALWTAAQYNIPTIFVIMNNGTYGTLRWSAGVLGAENVPGLDV

PGIDFRALAKGYGVQALKADNLEQLKGSLQEALSAKGPVLIEVSTVSPVK

Enzyme No 21:
                                                    (SEQ ID NO: 257)
MASVHGTTYELLRRQGIDIVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLDMRNPGSYYFCAAGGLGFALPAAIGVQLAEP

GRQVIAVIGDGSANYSISALWTAAQYNIPTIFVIMNNGTYGLLRWSAGVLGAENVPGLDV

PGIDFRALAKGYGVQALKADNLEQLKGSLQEALSAKGPVLIEVSTVSPVK

Enzyme No 22:
                                                    (SEQ ID NO: 258)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYRQYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYNCAAGGLGFALPAAIGVQLAEP

ERQVIAVIGDGSANYSISALWTAAQYNIPTIFVIMNNGTYGLLRWFAGVLEAENVPGLDVP

GIDFRALAKGYGVQALKADNLEQLKGSLQEALSAKGPVLIEVSTVSPVK

Enzyme No 23:
                                                    (SEQ ID NO: 259)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYRQYDPGQYLKPGTRLISVT
```

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYWCAAGGLGFALPAAIGVQLAEP

ERQVIAVIGDGSANYSISALWTAAQYNIPTIFVIMNNGTVGALRWFAGVLEAENVPGLDVP

GIDFRALAKGYGVQALKADNLEQLKGSLQEALSAKGPVLIEVSTVSPVK

Enzyme No 24:
(SEQ ID NO: 260)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYRQYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYRCAAGGVGFALPAAIGVQLAEP

ERQVIAVIGDGSANYSISALWTAAQYNIPTIFVIMNNGTVGALRWFAGVLEAENVPGLDVP

GIDFRALAKGYGVQALKADNLEQLKGSLQEALSAKGPVLIEVSTVSPVK

Enzyme No 25:
(SEQ ID NO: 261)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYRQYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYWCAAGGLGFALPAAIGVQLAEP

ERQVIAVIGDGSANYSISALWTAAQYNIPTIFVIMNNGTYGNLRWFAGVLEAENVPGLDVP

GIDFRALAKGYGVQALKADNLEQLKGSLQEALSAKGPVLIEVSTVSPVK

Enzyme No 26:
(SEQ ID NO: 262)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VTSSVRLNDQDLDILVKALNSASNPVIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYFCAAGGLGFALPAAIGVQLAEP

ERQVIAVIGDGSANYSISALWTAAQYNIPTIFVIMNNGTYGTLRWFAGVLEAENVPGLDVP

GIDFRALAKGYGVQALKADNLEQLKGSLQEALSAKGPVLIEVSTVSPVK

Enzyme No 27:
(SEQ ID NO: 263)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

-continued

```
DTLNDMAPENAIYLNESTSTTAQMWQRLNMRNPGSYYACAAGGLGFALPAAIGVQLAEP

ERQVIAVIGDGSANYSISALWTAAQYNIPTIFVIMNNGTYGTLRWFAGVLEAENVPGLDVP

GIDFRALAKGYGVQALKADNLEQLKGSLQEALSAKGPVLIEVSTVSPVK

Enzyme No 28:
                                                  (SEQ ID NO: 264)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYLCAAGGLGFALPAAIGVQLAEP

ERQVIAVIGDGSANYSISALWTAAQYNIPTIFVIMNNGTYGTLRWFAGVLEAENVPGLDVP

GIDFRALAKGYGVQALKADNLEQLKGSLQEALSAKGPVLIEVSTVSPVK

Enzyme No 29:
                                                  (SEQ ID NO: 265)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPEDAIYLNESTSTTAQMWQRLNMRNPGSYYRCAAGGVGFALPAAIGVQLAEP

ERQVIAVIGDGSANYSISALWTAAQYNVPTIFVIMNNGTYGALRWFAGVLEAENVPGLDV

PGIDFRALAKGYGVQALKADNLEQLKGSLQEALSAKGPVLIEVSTVSPVK

Enzyme No 30:
                                                  (SEQ ID NO: 266)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPEDAIYLNESTSTTAQMWQRLNMRNPGSYYRCAAGGVGFALPAAIGVQLAEP

ERQVIAVIGDGSANYSISALWTAAQYNVPTIFVIMNNGTYGGLRWFAGVLEAENVPGLDV

PGIDFRALAKGYGVQALKADNLEQLKGSLQEALSAKGPVLIEVSTVSPVK

Enzyme No 31:
                                                  (SEQ ID NO: 267)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF
```

DTLNDMAPEDAIYLNESTSTTAQMWQRLNMRNPGSYYWCAAGGSGFALPAAIGVQLAEP

ERQVIAVIGDGSANYSISALWTAAQYNVPTIFVIMNNGTYGNLRWFAGVLEAENVPGLDV

PGIDFRALAKGYGVQALKADNLEQLKGSLQEALSAKGPVLIEVSTVSPVK

Enzyme No 32:
(SEQ ID NO: 268)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYRQYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYWCAAGGLGFALPAAIGVQLAEP

ERQVIAVIGDGSANYSISALWTAAQYNIPTIFVIMNNGTYGLLRWFAGVLEAENVPGLDVP

GIDFRALAKGYGVQALKADNLEQLKGSLQEALSAKGPVLIEVSTVSPVK

Enzyme No 33:
(SEQ ID NO: 269)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYRQYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYRCAAGGLGFALPAAIGVQLAEP

ERQVIAVIGDGSANYSISALWTAAQYNIPTIFVIMNNGTYGLLRWFAGVLEAENVPGLDVP

GIDFRALAKGYGVQALKADNLEQLKGSLQEALSAKGPVLIEVSTVSPVK

Enzyme No 34:
(SEQ ID NO: 270)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYWCAAGGLGFALPAAIGVQLAEP

ERQVIAVIGDGSANYSISALWTAAQYNIPTIFVIMNNGTYGTLRWFAGVLEAENVPGLDVP

GIDFRALAKGYGVQALKADNLEQLKGSLQEALSAKGPVLIEVSTVSPVK

Enzyme No 35:
(SEQ ID NO: 271)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPENAIYLNESTSTTAQMWQRLNMRNPGSYYRCAAGGLGFALPAAIGVQLAEP

-continued

Enzyme No 36:
(SEQ ID NO: 272)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPEDAIYLNESTSTTAQMWQRLNMRNPGSYYRCAAGGVGFALPAAIGVQLAEP

ERQVIAVIGDGSANYSISALWTAAQYNVPTIFVIMNNGTYGTLRWFAGVLEAENVPGLDV

PGIDFRALAKGYGVQALKADNLEQLKGSLQEALSAKGPVLIEVSTVSPVK

Enzyme No 37:
(SEQ ID NO: 273)
MASVHGTTYELLRRQGIDTVFGNPGSNELPFLKDFPEDFRYILALQEACVVGIADGYAQAS

RKPAFINLHSAAGTGNAMGALSNAWNSHSPLIVTAGQQTRAMIGVEARLTNVDAANLPR

PLVKWSYEPASAAEVPHAMSRAIHMASMAPQGPVYLSVPYDDWDKDADPQSHHLFDRH

VSSSVRLNDQDLDILVKALNSASNPAIVLGPDVDAANANADCVMLAERLKAPVWVAPSA

PRCPFPTRHPCFRGLMPAGIAAISQLLEGHDVVLVIGAPVFRYHRYDPGQYLKPGTRLISVT

CDPLEAARAPMGDAIVADIGAMASALANLVEESSRQLPTAAPEPAKVDQDAGRLHPETVF

DTLNDMAPEDAIYLNESTSTTAQMWQRLNMRNPGSYYWCAAGGSGFALPAAIGVQLAEP

ERQVIAVIGDGSANYSISALWTAAQYNVPTIFVIMNNGTYGTLRWFAGVLEAENVPGLDV

PGIDFRALAKGYGVQALKADNLEQLKGSLQEALSAKGPVLIEVSTVSPVK

When one of the enzymes of the invention of sequence SEQ ID NO:274 as described herein was expressed in the Δfms1-Pyd41k strain, this yeast was able to grow on a pantothenate free medium.

These in vivo results show that the enzymes of the disclosure catalyze the transformation of oxaloacetate into malonic semialdehyde or one of its derivatives, such as for example malonate semialdehyde.

Example 3: 3-HP Production from MSA

3-HP Dehydrogenase

Most 3-HP dehydrogenase enzymes (Table 1) accept NADPH as a cofactor to convert malonate semialdehyde to 3-hydroxypropionic acid, but the use of NADH is desirable to get a redox balanced pathway. To contemplate this issue, the 3-HP dehydrogenase encoded by the HPD1 gene from the yeast *Candida albicans*, also active in *Saccharomyces* cells was identified and characterized as a 3-HP dehydrogenase working in the Propionyl-CoA degradation pathway and it was demonstrated to sustain efficient 3-HP synthesis from malonate semialdehyde, while using preferentially NADH as cofactor. The full-length HPD1.Cal gene was therefore cloned and expressed on a plasmid under the control of a strong promoter in *Saccharomyces cerevisiae* cells and compared with other enzymes. On the assay, it was used 20 mM of malonate semialdehyde and 2 mM of cofactor (NADPH or NADH). 3-HP was measured by GC-MS/MS after derivatization with BSTFA (data not shown).

TABLE 18

Constructed strain to test the 3-HP dehydrogenase.

| Strain | Genotype |
|---|---|
| YA3542-3 | MAT-α, ade2, adh1::[ADH1-4-URA3.Kl-loxP], adh3::RS, adh4::RS, adh5::RS, can1-100, his3, leu2, pdc1::HIS5.Sp-loxP, pdc6::LEU2.Kl-loxP, trp1, ura3 |

TABLE 19

Plasmids constructed with different 3-HP dehydrogenases.

| Plasmid | Description |
|---|---|
| pAD4003 | pRS314-pCCW12-YDFG.Ec-tRPL15A |
| pAD4042 | pRS314-pCCW12-YDF1-tRPL15A |
| pAD4287 | pRS314-pCCW12-YDF1-11-tRPL15A |
| pAD4346 | pRS314-pCCW12-HPD1.Cal-tRPL15A |

TABLE 20

Activity of 3-HP dehydrogenases based on cofactor consuming (in-vitro).

| Strain | Relevant genotype | Activity (nmol · min$^{-1}$ · mg$^{-1}$) NADPH | Activity (nmol · min$^{-1}$ · mg$^{-1}$) NADH |
|---|---|---|---|
| YA3542-3 | WT | Not detected | |
| YA3542-3 + pAD4003 | pRS314-pSTRONG-YDFG-0.Ec | 50 | Not detected |
| YA3 542-3 + pAD4042 | pRS316-pSTRONG-YDF1 | 2750 (+/− 250) | 2 (+/−1) |
| YA3542-3 + pAD4287 | pRS316-pSTRONG-YDF1-11 (S22N + A47D + R48F) | 50 | 48 (+/−2) |
| YA3542-3 + pAD4346 | pRS316-pSTRONG-HPD1.Cal | 200 | 2500 |

It was demonstrated that HPD1.Cal is highly active in the catalysis of 3-HP formation from MSA and further displays a preferential use of NADH as cofactor.

Example 4: 3-HP Production from Glucose—Carbon Flux Rewiring from PEP to Oxaloacetate This example describes enzymatic conversion of malonate semialdehyde to 3-HP. The MSA was produced by the β-alanine pathway (FIG. 3).

The redirection of the carbon flow towards oxaloacetate can be achieved through the implementation of the Oxaloacetate shunt, based on the strong expression of phosphoenolpyruvate carboxykinase from E. coli (PEPCK.Ec), while the yeast pyruvate kinase activity is strongly attenuated by (i) expressing the PYK1 gene from a weak promoter (pNUP57 or pMET25ΔF) and (ii) decreasing the half-life of the protein itself by its fusion to a specific degron (PYK1-7). Such strategy is described in WO2019011945A1 and WO2019011948A1.

Figure 20:
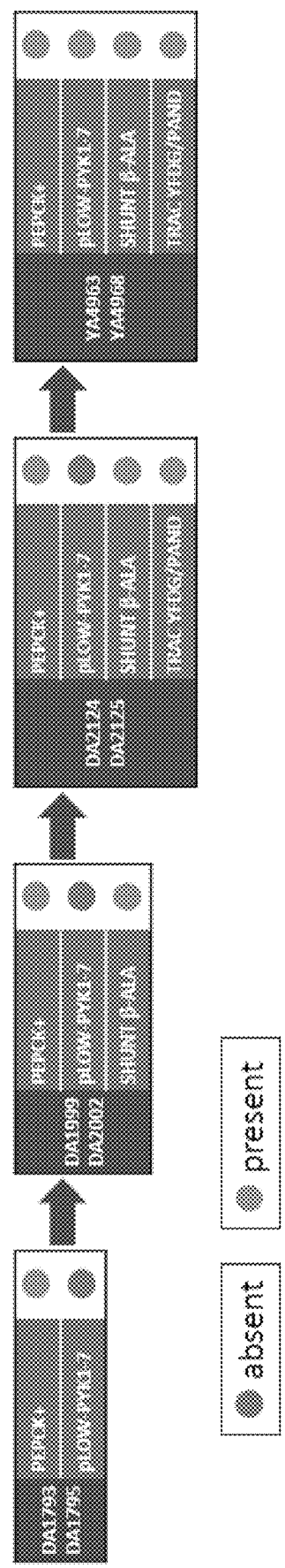
FIG. 20 depicts the workflow for engineering an organism to produce 3-HP from glucose.
Figure 21:
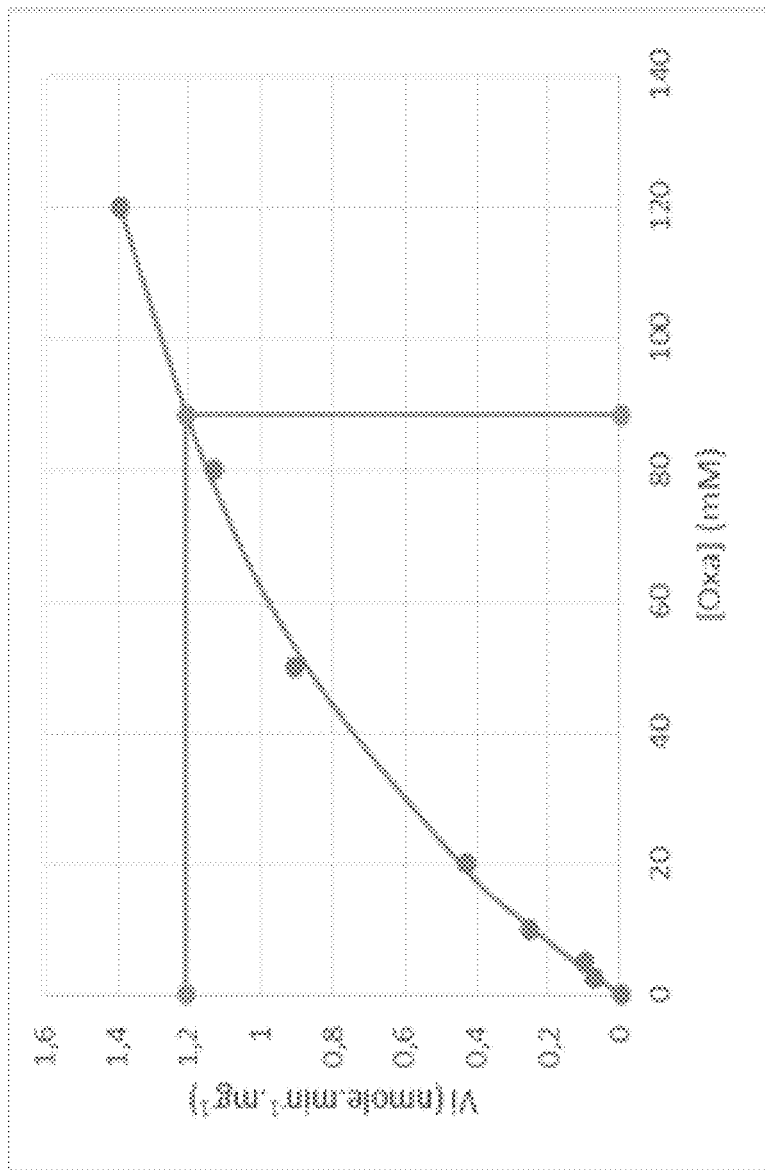
FIG. 21 is a plot and values demonstrating kinetic parameters for Enzyme No 1.
Figure 22:
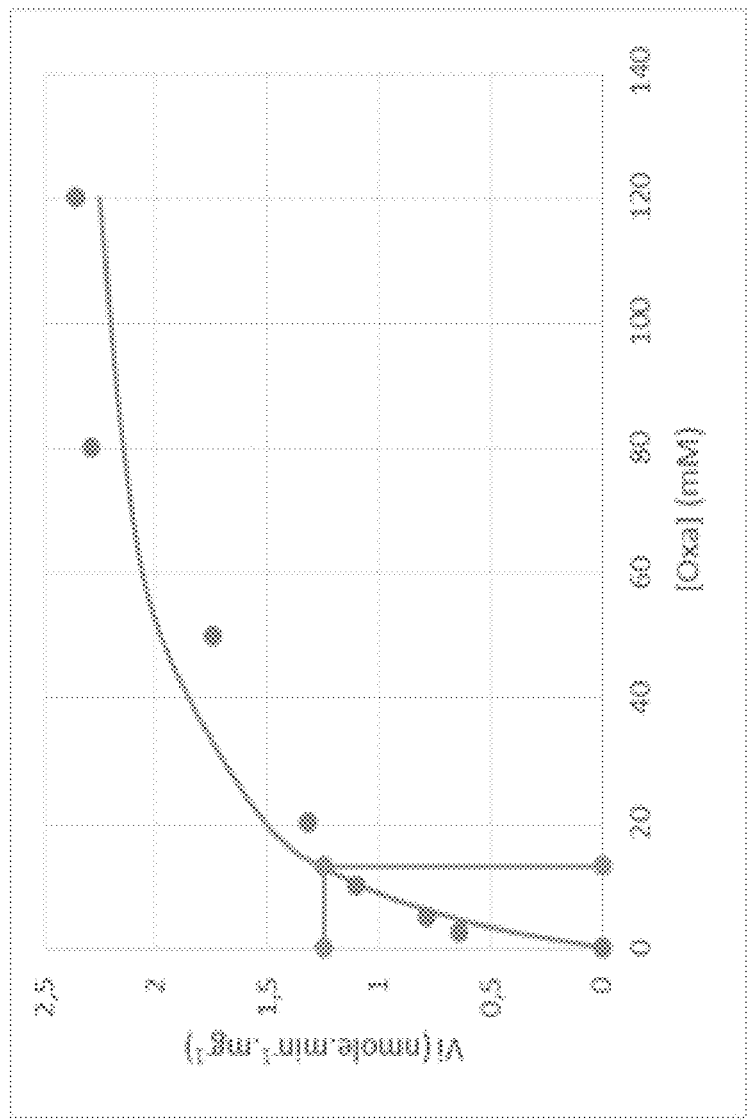
FIG. 22 is a plot and values demonstrating kinetic parameters for Enzyme No 6.
Figure 23:
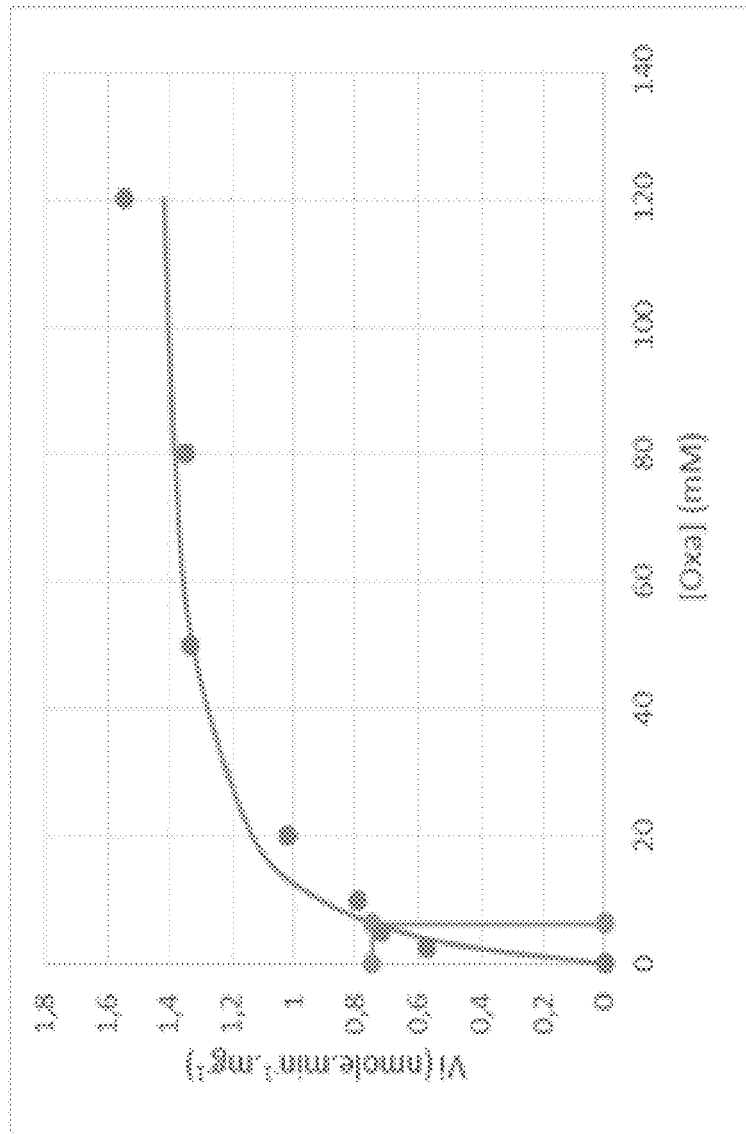
FIG. 23 is a plot and values demonstrating kinetic parameters for Enzyme No 7.
Figure 24:
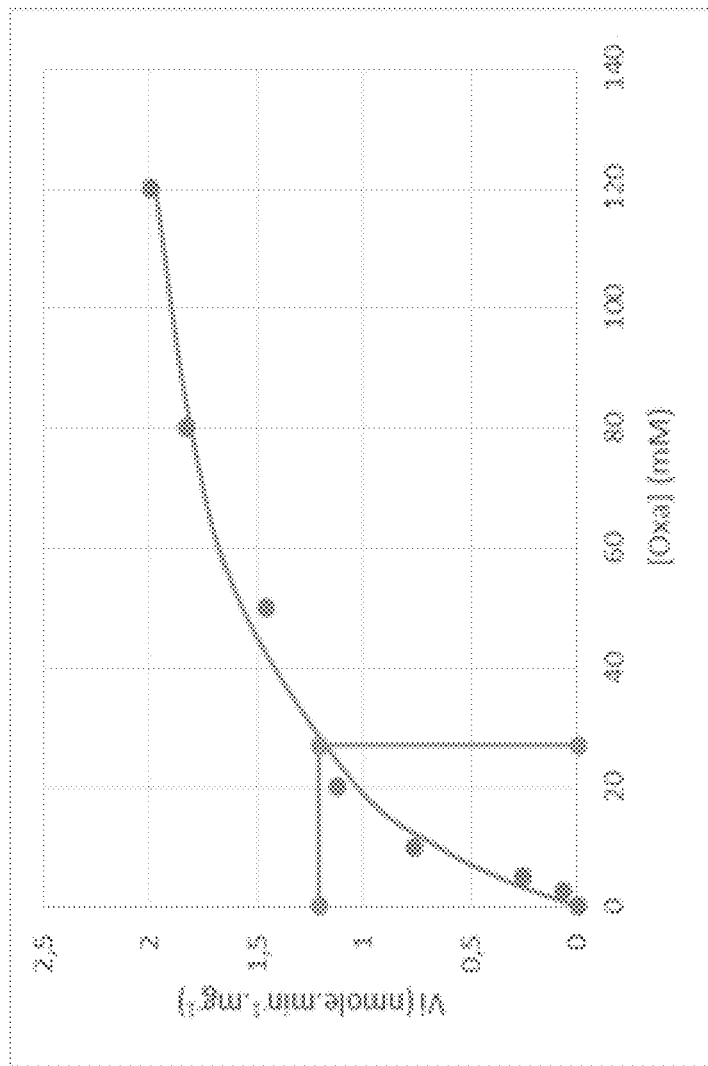
FIG. 24 is a plot and values demonstrating kinetic parameters for Enzyme No 8.
Figure 25:
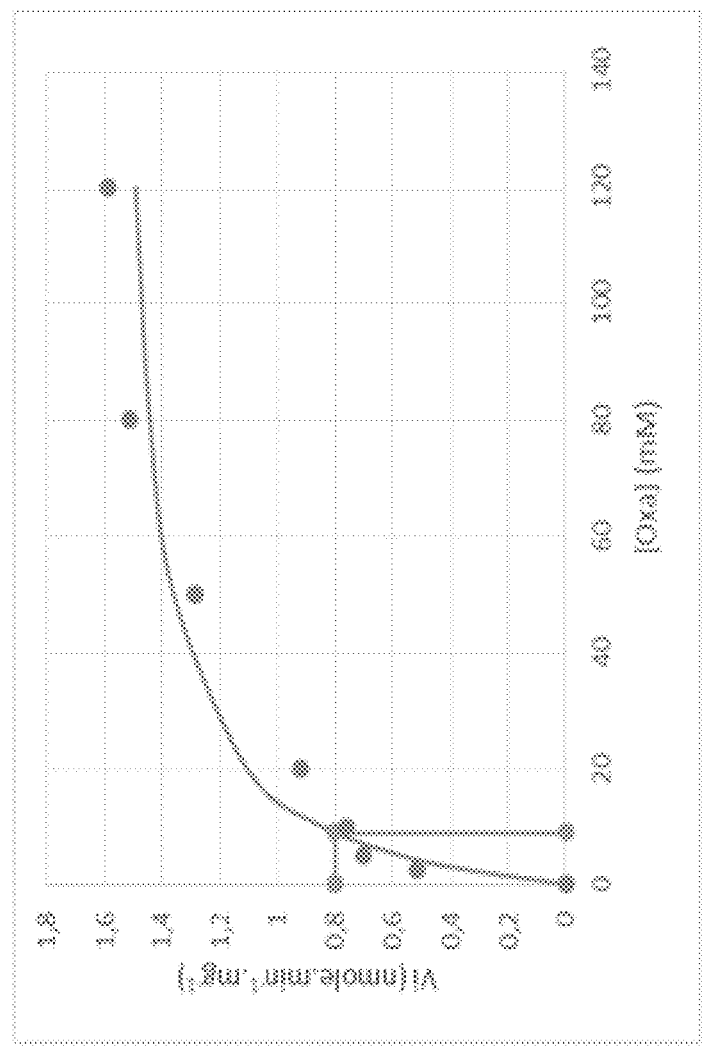
FIG. 25 is a plot and values demonstrating kinetic parameters for Enzyme No 9.

The engineering workflow (FIG. 20) starts with diploid strains that comprise an inactive oxaloacetate shunt, as the pLow-PYK1-7 is present in only one chromosome, and it ends by a sporulation step allowing the oxaloacetate shunt activation. The final haploid strains are YA4963 and YA4968 (Table 21).

Strains were thus assayed for 3-HP production in anaerobic growth conditions: 10 mL of rich medium in the presence of 8% glucose in 50 mL closed Falcon tubes. Stirring at 135 rpm (50 mm shaking diameter). The 3-HP analysis was done after 48 h of growth using GC/FID (after 3-HP extraction in presence of 1-butanol).

TABLE 21

Strains constructed to improve carbon flux rewiring from PEP.

| Strain | Genotype |
|---|---|
| DA2124-14 | MAT-a/MAT-α, can1-100/can1-100, his3/his3, JLP1/jlp1::[TRP1.Kl-loxP-PYK1-7], leu2/leu2, MET14/met14::[HIS3.Sba-RS-PAND.Tca-PYD4.Lk-YDFG-0.Ec], PYK1/pyk1::[LEU2.Kl-loxP-PEPCK-1.Ec-AAT2-PEPCK-1.Ec], trp1/trp1, ura3/ura3::[PAND.Tca-YDFG-0.Ec-URA3]x9 |
| YA4963-25A | jlp1::[TRP1.Kl-loxP-pNUP57-PYK1-7], met14::[HIS3.Sba-RS-PAND.Tca-PYD4.Lk-YDFG-0.Ec], pyk1::[LEU2.Kl-loxP-PEPCK-1.Ec-AAT2-PEPCK-1.Ec], ura3::[PAND.Tca-YDFG-0.Ec-URA3]x9 |
| YA4968-12C | jlp1::[TRP1.Kl-loxP-pMET25DF-PYK1], met14::[HIS3.Sba-RS-PAND.Tca-PYD4.Lk-YDFG-0.Ec], pyk1::[LEU2.Kl-loxP-PEPCK-1.Ec-AAT2-PEPCK-1.Ec], ura3::[PAND.Tca-YDFG-0.Ec-URA3]x10 |

In fermentative conditions, PYK1 attenuated strains (YA4963-21C and YA4963-25A) produced more 3-HP (7.8 g/L of 3-HP) than their parental strain (0.9 g/L of 3-HP) without PYK1 attenuation (DA2124-12) (Table 22)

TABLE 22

3-HP production (in-vivo) after PYK1-7 attenuation.

| Strain | OD 600 nm | 3-HP (g · L$^{-1}$) | Glucose (g · L$^{-1}$) | Ethanol (g · L$^{-1}$) | Glycerol (g · L$^{-1}$) | PYK1 Activity (nmol · min$^{-1}$ · mg$^{-1}$) |
|---|---|---|---|---|---|---|
| DA2124-12 | 59 | 0.9 | 0 | 39 | 2 | 6200 |
| YA4963-21C | 37 | 5.1 | 42 | 15 | 5 | 130 |
| YA4963-25A | 22 | 7.8 | 44 | 11 | 8 | 150 |

Pyruvate Kinase activity has been determined as described in Aust, A.; Yun, S. L.; Suelter, C. H. (1975) Methods Enzymol. 42C, 176-182

Example 5: 3-HP Production from Glucose Through Oxaloacetate Decarboxylase

Oxaloacetate decarboxylase enzyme candidates have been prospected and successfully engineered to deliver an active enzyme to convert oxaloacetate into malonate semialdehyde and in a second step to leverage a novel fermentative metabolic pathway to produce MSA, 3-HP and derivatives from glucose.

To illustrate the oxaloacetate decarboxylase enzyme engineering R&D efforts and the magnitude of the MDLC enzyme (Pseudomonas putida) engineering results, the resulting activity can be compared to the value obtained in a similar approach with the wild type aspartate decarboxylase (PAND.Tca of Tribolium castaneum), that catalyzes the aspartate conversion to β-alanine. As described previously, 5-8 g/L of 3-HP was successfully produced from glucose through the β-alanine route by the use of the enzyme aspartate decarboxylase (PAND.Tca). As described in the table below, the variant MDLC-54 has been shown to be as active as the aspartate decarboxylase PAND.Tca (4× lower activity only), indicating such variant would be able to sustain the in-vivo production of 3-HP from glucose (Table 23).

TABLE 23

Activities of MDLC-54 and PAND.Tca

| Enzyme | Activity (nmol/min/mg) |
|---|---|
| Engineered variant MDLC-54 | 10-15 |
| Wild type Pand.Tca | 2-2.5 |

An Oxaloacetate decarboxylase assay was carried out with yeast cell extracts containing 50, 100, 150 and 200 µg of total protein in 100 mM phosphate buffer pH 6 for 40 min at 30° C. in the presence of oxaloacetate (20 mM), $MgSO_4.7H_2O$ (2 mM), TPP (2 mM), NADPH (2 mM) and a purified YdfG enzyme (4 µg/100 µL) The formation of 3-HP was measured by GC/MS/MS after derivatization with BSTFA.

Aspartate decarboxylase (PAND.Tca) was carried out with yeast cell extracts containing 20, 40, 60 and 80 µg of total protein in 100 mM phosphate buffer pH 7 for 20 min at 30° C. in the presence of aspartate (20 mM). The formation of Beta-alanine was measured by UPLC/UV after derivatization with AQC (6-Aminoquinolyl-n-hydroxysuccimidyl carbamate).

Based on these results, assays are additionally performed to analyse the kinetic properties of enzymes of the invention through the measure of their $K_m$ and $V_{max}$, using extracts of yeasts expressing the different MDLC variants.

The kinetic assays are carried out with 100 µg of yeast extracts for 30 minutes in the presence of increasing concentrations of oxaloacetate (2.5, 5, 10, 20, 40, 80 and 120 mM), of purified YdfG (NADP-dependent 3-hydroxy acid hydrogenase—EC 1.1.1.298) from *E. coli* (4 µg/100 µL) and 2 mM NADPH.

The efficiency of the enzymes of the invention is assayed through the formation of 3-HP that is measured by GC/MS/MS after derivatization with BSTFA (N,O-bis(trimethylsilyl)trifluoroacetamide).

As negative control, this assay is performed on a yeast extract not comprising an enzyme according to the invention. No significant activity is detected.

The results obtained with yeast strains comprising either enzyme No 1 (SEQ ID NO: 2), enzyme No 6 (SEQ ID NO: 242), enzyme No 7 (SEQ ID NO: 243), enzyme No 8 (SEQ ID NO: 244) or enzyme No 9 (SEQ ID NO: 245) are in particular represented in FIG. 21, FIG. 22, FIG. 23, FIG. 24, and FIG. 25, respectively.

It can be observed that very low $K_m$ are obtained, demonstrating that the enzymes of the invention are very effective.

Example 6: Acetone Production from MSA

Acetyl-CoA Production from MSA

Genes of table 2 were cloned and expressed on a plasmid under the control of a strong promoter in *Saccharomyces cerevisiae* cells (Table 24).

No MSD activity was detected using NADP as a cofactor. Using NAD as the co-enzyme, both MSD.Cal and MSD.Pa were active with an activity of 40 nmol·min$^{-1}$·mg$^{-1}$ (Table 25).

Yeast extract from the considered strains was incubated in the presence of 80 mM Beta-alanine, 20 mM Oxoglutarate, 100 µM Pyridoxal Phosphate, 1 mM NAD, 0.5 mM Coenzyme A and 1 mM DTT in phosphate buffer 100 mM pH 7.5. Beta-alanine and oxoglutarate were converted in MSD and β-alanine by the PYD-4 transaminase. The MSD activity was then monitored by following NADH appearance by UV absorbance at 340 nM. No increase of absorbance at 340 nM was observed if either oxoglutarate or beta-alanine was omitted, or in a strain in which no MSD activity was expressed. This assay was adapted from Andersen and Piskur FEBS journal, (2007) 274, 1804-1817 and Waters and Venables FEMS Microbiology Letters 34 (1986) 279-282.

TABLE 24

Strains constructed to acetone production.

| Strain | Genotype |
|---|---|
| YA4666-1 | MAT-a, ade2, can1-100, fms1::ADE2.Sba-RS, his3, jlp1::[HIS3.Sba-RS-PYD4.Lk], trp1, ura3 |
| YA4750-2/-4 | MAT-a, ade2, can1-100, fms1::ADE2.Sba-RS, his3, jlp1::[HIS3.Sba-RS-PYD4.Lk], met14::[TRP1.K1-RS-MSD.Cal], trp1, ura3 |
| YA4751-2 | MAT-a, ade2, can1-100, fms1::ADE2.Sba-RS, his3, jlp1::[HIS3.Sba-RS-PYD4.Lk], met14::[TRP1.Kl-RS-MSD.Pa], trp1, ura3 |

TABLE 25

Activity of malonate semialdehyde dehydrogenase based on cofactor consumption.

| Strain | Relevant genotype | Activity (nmol · min$^{-1}$ · mg$^{-1}$) NADP | Activity (nmol · min$^{-1}$ · mg$^{-1}$) NAD |
|---|---|---|---|
| YA4666-1 | WT | Not detected | Not detected |
| YA4750-2 | YA4666-1 + pSTRONG-MSD.Cal | Not detected | 40 |
| YA4751-2 | YA4666-1 + pSTRONG-MSD.Pa | | 40 |
| YA4750-4 | | | 40 |

Acetoacetyl-CoA Production from Acetyl-CoA

For the conversion of acetyl-CoA to acetoacetyl-CoA, the enzyme ERG10 (*S. cerevisiae*) that is able to catalyze this reaction was preferentially used (data not shown), according to Hiser L, et al. (1994) ERG10 from *Saccharomyces cerevisiae* encodes acetoacetyl-CoA thiolase. J Biol Chem 269(50):31383-9.

Acetone Production from Acetyl-CoA In Vivo

To identify the best combination of acetoacetyl-CoA transferase/acetoacetate decarboxylase, a combination of different gene candidates have been integrated as clusters in the YA4565-2 strain (Table 26), in which the carbon flux is directed through the β-Alanine shunt allowing malonate semialdehyde production (FIG. 3).

TABLE 26

Constructed strains to produce acetone.

| Strain | Relevant Genotype |
|---|---|
| YA4565-2 | his3, leu2, met14::[HIS3.Sba-RS-PAND.Tca-PYD4.Lk], trp1, ura3 |
| YA5060 | YA4565-2 + jlp1::[LEU2.Sba-RS-MSD.Pa-MSD.Cal-ERG10-ATOA-0.Ec-ATOD-0.Ec-ADC-0.Ca-PTA.Cg-ACKA.Ec] |
| YA5061 | YA4565-2 + jlp1::[LEU2.Sba-RS-MSD.Pa-MSD.Cal-ERG10-ATOA-0.Ec- |

TABLE 26-continued

Constructed strains to produce acetone.

| Strain | Relevant Genotype |
|---|---|
| | ATOD-0.Ec-ADC-0.Ca-PTA.Cg-ACKA.Ec] |
| YA5062 | YA4565-2 + jlp1::[LEU2.Sba-RS-MSD.Pa-MSD.Cal-ERG10-ATOA-0.Ec-ATOD-0.Ec-ADC-0.Pp-PTA.Cg-ACKA.Ec] |
| YA5063 | YA4565-2 + jlp1::[LEU2.Sba-RS-MSD.Pa-MSD.Cal-ERG10-CTFA-0.Ca-CTFB-0.Ca-ADC-0.Ca-PTA.Cg-ACKA.Ec] |
| YA5064 | YA4565-2 + jlp1::[LEU2.Sba-RS-MSD.Pa-MSD.Cal-ERG10-CTFA-0.Ca-CTFB-0.Ca-ADC-0.Cbe-PTA.Cg-ACKA.Ec] |
| YA5065 | YA4565-2 + jlp1::[LEU2.Sba-RS-MSD.Pa-MSD.Cal-ERG10-CTFA-0.Ca-CTFB-0.Ca-ADC-0.Pp-PTA.Cg-ACKA.Ec] |

Strains were cultured in 25 mL of rich medium in the presence of 2% glucose in Erlenmeyer flask closed with a silicon cap with two 1 mL pipette tip with filter and stirring was maintained at 135 rpm (50 mm shaking diameter). Samples are kept in ice until analysis or frozen at −20° C. The acetone was measured by GC/MS head space after 24 h of growth (Table 27).

TABLE 27

Acetone production (in vivo) using proposed genes.

| Strain | OD 600 nm | Total culture Acetone (g · L$^{-1}$) | Supernatant Acetone (g · L$^{-1}$) |
|---|---|---|---|
| YA4565-2 | 36 | 0 | 0 |
| YA5063-1 | 31 | 0.1 | 0.1 |
| YA5063-2 | 35 | 0.1 | 0.1 |
| YA5064-2 | 31 | 0.1 | 0.1 |
| YA5064-3 | 33 | 0.1 | 0.1 |
| YA5065-1 | 37 | 0.2 | 0.2 |
| YA5065-2 | 36 | 0.2 | 0.2 |
| YA5060-1 | 31 | 0.3 | 0.3 |
| YA5060-2 | 33 | 0.3 | 0.3 |
| YA5061-1 | 39 | 0.1 | 0.1 |
| YA5061-2 | 31 | 0.1 | 0.1 |
| YA5062-1 | 33 | 0.5 | 0.5 |
| YA5062-2 | 33 | 0.5 | 0.5 |

In both series of strains, the most efficient acetoacetate decarboxylase was ADC-0 of *Paenibacillus polymyxa*. The best combination of enzymes corresponded to acetoacetyl-CoA transferase ATOA-0-ATOD-0 of *Escherichia coli* and acetoacetate decarboxylase ADC-0 of *Paenibacillus polymyxa*. To increase acetone production, additional copies of MSD.Pa and PanD.Tca were integrated within the genome of the YA5060 and YA5062 strains (Table 28).

TABLE 28

Strains constructed with additional copies of genes to produce acetone.

| Strain | Relevant Genotype |
|---|---|
| YA4565-2 | his3, leu2, met14::[HIS3.Sba-RS-PAND.Tca-PYD4.Lk], trp1, ura3 |
| YA5060-1 | jlp1::[LEU2.Sba-RS-MSD.Pa-MSD.Cal-ERG10-ATOA-0.Ec-ATOD-0.Ec-ADC-0.Ca-PTA.Cg-ACKA.Ec], leu2, met14::[HIS3.Sba-RS-PAND.Tca-PYD4.Lk] |
| YA5182-4/-11 | YA5060-1 ura3::[PAND.Tca-MSD.Pa-URA3]x2/x4 |
| YA5062-1 | jlp1::[LEU2.Sba-RS-MSD.Pa-MSD.Cal-ERG10-ATOA-0.Ec-ATOD-0.Ec-ADC-0Pp-PTA.Cg-ACKA.Ec], leu2, met14::HIS3.Sba-RS-PAND.Tca-PYD4.Lk |
| YA5183-1/-23 | YA5062-1 ura3::[PAND.Tca-MSD.Pa-URA3]x1/x5 |

The resulting strains YA5182 and YA5183 were grown in 25 mL of rich medium in the presence of 8% glucose in Erlenmeyer flask with a silicon cap+two 1 mL pipette tips with filter. Stirring was maintained at 135 rpm (50 mm shaking diameter) and the production of acetone was measured after 48 h of growth by GC/MS-MS head space analysis (Table 29).

TABLE 29

Acetone production by strains having more genes copies of MSD.Pa and PanD.Tca.

| Strain | OD 600 nm | Acetone (g · L$^{-1}$) | Ethanol (g · L$^{-1}$) |
|---|---|---|---|
| YA4565-2 | 51 | 0 | 39 |
| YA5060-1 | 69 | 0.7 | 36 |
| YA5182-4 | 77 | 1.0 +/− 0.1 | 34 |
| YA5182-11 | 75 | 1 | 35 |
| YA5062-1 | 68 | 0.8 | 35 |
| YA5183-1 | 70 | 1.1 | 34 |
| YA5183-23 | 79 | 1.2 +/− 0.1 | 34 |

Example 7. Propanol Production from 3-HP

Propionyl-CoA Production from 3-HP Using Propionyl-CoA Synthase of *Chloroflexus Aurantiacus* In Vitro The PCS of *Chloroflexus aurantiacus* activity was measured using two strategies: a) integration of multiple copies of the PCS.Cau gene under the control of a strong promoter and b) usage and evaluation of different synonymous sequences of the gene obtained by several re-encoding algorithms to avoid any deleterious recombination event. The best variant was PCS-A.Cau and the activity was higher according to the number of gene copies. It is noteworthy that at 30° C., the enzyme activity was 8-10-fold lower than at 50° C.

The results were measured by production of Propionyl-CoA by UPLC/UV as described in Alder and Fuchs (2002) Journal of biological chemistry, 277 (14), 12137-12143

TABLE 30

Strains constructed with different PCS genes to produce propanol.

| Strain | Relevant Genotype |
|---|---|
| YA4788-2 | MAT-a, can1-100, his3, jlp1::[LEU2.Sba-RS-PCS.Cau], leu2, met14::[HIS3.Sba-RSPAND.Tca-PYD4.Lk-YDFG-0.Ec], trp1, ura3::[PAND.Tca-URA3]x14 |
| YA4971 | MAT-a, can1-100, his3, jlp1::[LEU2.Sba-RS-PCS-A.Cau], leu2, met14::[HIS3.Sba- |

TABLE 30-continued

Strains constructed with different PCS genes to produce propanol.

| Strain | Relevant Genotype |
|---|---|
| YA5068 | RS-PAND.Tca-PYD4.Lk-YDFG-0.Ec], trp1, ura3::[PAND.Tca-URA3]x14 his3, jlp1::[LEU2.Sba-RS-PCS-A.Cau-PCS-A.Cau-PCS-A.Cau-PCS-A.Cau], leu2, met14::[HIS3.Sba-RS-PAND.Tca-PYD4.Lk-YDFG-0.Ec], trp1, ura3::[PAND.Tca-URA3]x14 |
| YA5133 | MAT-a, can1-100, his3, jlp1::[LEU2.Sba-RS-PCS-D.Cau], leu2, met14::[HIS3.Sba-RS-PAND.Tca-PYD4.Lk-YDFG-0.Ec], trp1, ura3::[PAND.Tca-URA3]x14 |

TABLE 31

Activity of different variants of PCS in different temperatures evaluated by cofactor consumption.

| Strain | Relevant genotype | Activity (nmol · min$^{-1}$ · mg$^{-1}$) 50° C. | Activity (nmol · min$^{-1}$ · mg$^{-1}$) 30° C. |
|---|---|---|---|
| YA4788-2 | PCS.Cau | 15 | ND |
| YA4971-2/-3 | PCS-A.Cau | 42 | 5 |
| YA5133-2/-6 | PCS-D.Cau | 41 | 5 |
| YA5068-18 | 4x PCS-A.Cau | 200 | 21 |

Propionyl-CoA Production from 3-HP Using Single Enzymes (In Vitro) Screening of 3-HP-CoA Transferase The 3-hydroxypropionyl-coA transferase activities from *Cupriavidus necator* and *Clostridium propionicum* were assayed. The in vitro activity was measured essentially as described in Volodina E., Schürmann M., Lindenkamp N., Steinbüchel A. (2014) Appl Microbiol Biotechnol 98:3579-3589. Crude extracts of strains YA4951-4, YA4952-2 and YA5067 (Table 32) were diafiltrated (cut-off 3 Kda) and the protein content was evaluated. Extracts containing, 5, 10, 20, 40, 80 or 160 µg of protein were incubated in presence of 20 mM 3 HP, 2 mM acetyl-CoA, 1 mM NADPH and 2 mM MgCl$_2$ for 30 minutes at 30° C. The reaction was then stopped by addition of HClO$_4$ 1% and the quantity of 3 hydroxypropionyl-CoA formed was determined by HPLC. The most active enzyme was PCT from *Clostridium propionicum*.

TABLE 32

Strains constructed with different PCT genes to produce 3-HP-CoA from 3-HP.

| Strain | Relevant Genotype |
|---|---|
| YA4951-4 | jlp1::[LEU2.Sba-RS-PCT-0.Cne-PCT-0.Cne-PCT-0.Cne-PCT-0.Cne] |
| YA4952-2 | jlp1::[LEU2.Sba-RS-PCT-0.Cp-PCT-0.Cp-PCT-0.Cp-PCT-0.Cp] |
| YA5067 | MAT-a, ade2, can1-100, his3, leu2::[HIS3.Sba-RS-PCT-0.Cp-HPCD-0.Sac-HPCD-0.Sac-HPCD-0.Sac-HPCD-0.Sac], trp1, ura3 |

TABLE 33

Activity of PCT measured by acetyl-CoA consumption.

| Strain | Relevant genotype | Activity (nmol · min$^{-1}$ · mg$^{-1}$) |
|---|---|---|
| YA4951-4 | PCT-0.Cne x4 | 140 |
| YA4952-2 | PCT-0.Cp x4 | 240 |
| YA5067-1 | PCT-0.Cp x1 | 77 |
| YA5067-4 | | 64 |

Screening of 3-HP-CoA Dehydratase

3-HP-CoA dehydratases from *Metallosphaera sedula* (HPCD.Mse), *Bacillus* sp. (HPCD.Bsp), *Sporanaerobacter acetigenes* (HPCD-O.Sac) and enoyl-CoA hydratase of *Ruegeria pomeroyi* (ENCD.Rp) were assayed. The strain YA4952-2 was transformed with the following plasmids.

TABLE 34

Plasmids constructed with 3-hydroxypropionyl-CoA dehydratases/Enoyl-CoA hydratase.

| Plasmid | Description |
|---|---|
| pAD3967 | pFL45L-pCCW12.Sba-HPCD.Mse-tRPL15A |
| pAD3968 | pFL45L-pCCW12.Sba-HPCD.Bsp-tRPL15A |
| pAD3969 | pFL45L-pCCW12.Sba-HPCD-0.Sac-tRPL15A |
| pAD3970 | pFL45L-pCCW12.Sba-ENCD.Rp-tRPL15A |

The in vitro activity was measured essentially as described in Asao, M. & Alber, B. E (2013). Journal of Bacteriology 195, 4716-4725. Crude extracts of the strain YA4952-2 transformed with the plasmids described in table 34 were diafiltrated (cut-off 3 Kda) and the protein content was evaluated. Extracts containing, 5, 10, 20, 40 or 80 µg of protein were incubated in presence of 20 mM 3 HP, 2 mM acetyl-CoA, 1 mM NADPH and 2 mM MgCl$_2$ for 30 minutes at 30° C. The reaction was then stopped by addition of HClO$_4$ 1% and the quantity of acrylyl-CoA formed was determined by HPLC—The 3-HP-CoA dehydratases of *Metallosphaera sedula* and *Sporanaerobacter acetigenes* were slightly more active than the other candidates.

TABLE 35

Activity of 3-hydroxypropionyl-CoA dehydratase measured by acrylyl-CoA peak area.

| Strain | µg of crude extract | Peak area |
|---|---|---|
| YA4952-2 | 80 | <LOQ* |
| YA4952-2 + pAD3970 | 80 | <LOQ |
| YA4952-2 + pAD3968 | 10 | 4000 |
| | 20 | 5000 |
| | 40 | 7000 |
| | 80 | 8000 |
| YA4952-2 + pAD3969 | 10 | 5000 |
| | 20 | 8000 |
| | 40 | 9000 |
| | 80 | 10000 |
| YA4952-2 + pAD3967 | 10 | 5000 |
| | 20 | 8000 |
| | 40 | 11000 |
| | 80 | 13000 |

*limit of quantification

Screening of Acrylyl-CoA Reductase

The acrylyl-CoA reductase of *Ruegeria pomeroyi* was assayed in vitro essentially as described in Asao, M. & Alber, B. E (2013). Journal of Bacteriology 195, 4716-4725.

Crude extracts of the strain YA4952-2 were diafiltrated (cut-off 3 Kda) and the protein content was evaluated. Extracts containing, 5, 10, 20 or 30 µg of protein were incubated in presence of 20 mM 3 HP, 2 mM acetyl-CoA, 1 mM NADPH and 2 mM $MgCl_2$ for 30 minutes at 30° C. The reaction was then stopped by addition of $HClO_4$ 1% and the quantity of propionyl-CoA formed was determined by HPLC. It was possible to observe that ACR from *Ruegeria pomeroyi* was highly active in yeast cells.

TABLE 36

Strains constructed with acrylyl-CoA reductase from *Ruegeria pomeroyi*.

| Strain | Relevant Genotype |
|---|---|
| YA5057 | MAT-a, ade2, can1-100, his3, jlp1::[LEU2.Sba-RS-PCT-0.Cp-PCT-0.Cp-PCT-0.Cp-PCT-0.Cp], leu2::[HIS3.Sba-RS-ACR-0.Rp-HPCD-0.Sac-HPCD-0.Sac-HPCD-0.Sac-HPCD-0.Sac], trp1, ura3 |
| YA5058 | MAT-a, ade2, can1-100, his3, jlp1::[LEU2.Sba-RS-PCT-0.Cp-PCT-0.Cp-PCT-0.Cp-PCT-0.Cp], leu2::[HIS3.Sba-RS-HPCD-0.Sac-ACR-0.Rp-ACR-0.Rp-ACR-0.Rp-ACR-0.Rp], trp1, ura3 |

TABLE 37

Activity of acrylyl-CoA reductase measured by cofactor consumption.

| Strain | Relevant genotype | Activity (nmol · min$^{-1}$ · mg$^{-1}$) |
|---|---|---|
| YA4952-2 | WT | ND |
| YA5057-2 | ACR-0.Rp x1 | 700 |
| YA5057-9 |  | 400 |
| YA5058-5 | ACR-0.Rp x4 | 1200 |
| YA5058-15 |  | 1700 |

Propanol Production from Propionyl-CoA In Vitro

To this step, two different pathways can be used to convert propionyl-CoA into 1-propanol. The first one relies on the implementation of the multifunctional ADHE enzyme of *Clostridium arbusti*, while the second one proceeds through the intermediary formation of propionaldehyde by a propionyl-CoA reductase from *Paraburkholderia xenovorans* or *Salmonella enterica* with or without endogenous overexpression oh the alcohol dehydrogenase ADH1. The reaction was measured by monitoring NADH consumption at 340 nm using 1 mM propionyl-CoA as substrate. Results demonstrated that the PDUP enzyme from *Salmonella enterica* was the best candidate to catalyze the reaction.

TABLE 38

Strains constructed to test activity of propionyl-CoA reductase and alcohol/aldehyde dehydrogenase.

| Strain | Relevant Genotype |
|---|---|
| YA5051 | jlp1::[LEU2.Sba-RS-PCT-0.Cne-PCT-0.Cne-PCT-0.Cne-PCT-0.Cne] |
| YA5212 | MAT-a, ade2::[TRP1.Sba-loxP-ADHE-0A.Car-ADHE-0A.Car-ADHE-0A.Car], can1-100, his3, jlp1::[LEU2.Sba-RS-PCT-0.Cp-PCT-0.Cp-PCT-0.Cp-PCT-0.Cp], leu2::[HIS3.Sba-RS-ACR-0.Rp-HPCD-0.Sac-HPCD-0.Sac-HPCD-0.Sac-HPCD-0.Sac] |
| YA5214 | MAT-a, ade2::[TRP1.Sba-loxP-PDUP.Sen-PDUP.Sen-PDUP.Sen], can1-100, his3, jlp1::[LEU2.Sba-RS-PCT-0.Cp-PCT-0.Cp-PCT-0.Cp-PCT-0.Cp], leu2::[HIS3.Sba-RS-ACR-0.Rp-HPCD-0.Sac-HPCD-0.Sac-HPCD-0.Sac-HPCD-0.Sac] |
| YA5215 | MAT-a, ade2::[TRP1.Sba-loxP-PDUP.Sen-PDUP.Sen-PDUP.Sen-ADH1], can1-100, his3, jlp1::[LEU2.Sba-RS-PCT-0.Cp-PCT-0.Cp-PCT-0.Cp-PCT-0.Cp], leu2::[HIS3.Sba-RS-ACR-0.Rp-HPCD-0.Sac-HPCD-0.Sac-HPCD-0.Sac-HPCD-0.Sac] |

TABLE 39

Activity of propionyl-CoA reductase and alcohol/aldehyde dehydrogenase measured by cofactor consumption.

| Strain | Relevant genotype | Activity (nmol · min$^{-1}$ · mg$^{-1}$) |
|---|---|---|
| YA5057-2 | WT | ND |
| YA5051-1 | +MHPF.Px x3 | ND |
| YA5212-4 | YA5057-2 + ADHE-0.Car x3 | 45 |
| YA5214-1 | YA5057-2 + PDUP. Sen x3 | 1500 |
| YA5214-4 |  | 2200 |
| YA5215-1 | YA5057-2 + PDUP. Sen x3 + ADH1 | 2200 |

Propanol Production from 3-HP In Vitro

The production of propanol from 3-HP was assayed in vitro using cell extracts of the YA5214 and YA5215 strains. The assay was carried out in phosphate buffer 0.1M pH 6.5 in the presence of 2 mg/mL of cell extract at 30° C. for 60 minutes, using 20 mM of 3-HP+2 mM of acetyl-CoA+2.8 mM of NADPH+4 mM of NADH. 1-propanol production was monitored by GC/MS-MS head space analysis.

TABLE 40

In-vitro production of 1-propanol

| Strain | Propanol (mg · L$^{-1}$) | Activity (nmol · min$^{-1}$ · mg$^{-1}$) | Propionyl-CoA (mg · L$^{-1}$) |
|---|---|---|---|
| YA5214-1 | 28 | 4 | 59 |
| YA5214-4 | 29 | 4 | 60 |
| YA5215-2 | 35 | 5 | 6 |

Propanol Production from 3-HP In Vivo

To evaluate 1-propanol synthesis, YA5212, YA5214 and YA5215 strains were growth in the presence of glucose and fed with 3-HP. The cells were grown in 25 mL of rich medium in the presence of 4% glucose in Erlenmeyer flasks with a silicon cap+two 1 mL pipette tip with filter. After 24 h of culture, another amount of 4% glucose was added. The stirring was maintained at 135 rpm (50 mm shaking diameter). The presence of 1-propanol into the growth medium was measured by GC/MS-MS head space analysis.

TABLE 41

Strains constructed to produce 1-propanol

| Strain | Relevant Genotype |
|---|---|
| YA4613-7 | MAT-a, can1-100, his3, leu2, met14::[HIS3.Sba-RS-PAND.Tca-PYD4.Lk-YDFG-0.Ec], trp1, ura3::[PAND.Tca-URA3]x8 |

TABLE 42

1-Propanol production after 48 h of culture.

| Strain | 3-HP added | OD 600 nm | 1-propanol (mg · L$^{-1}$) |
|---|---|---|---|
| YA4613-7 | — | 74 | <20 |
|  | 5 g · L-1 | 70 | <20 |
| YA5212-1 | — | 37 | <20 |
|  | 5 g · L-1 | 51 | 44 |
| YA5214-1 | — | 40 | 26 |
|  | 1 g · L-1 | 40 | 58 |
|  | 2 g · L-1 | 49 | 90 |
|  | 5 g · L-1 | 46 | 178 |
| YA5214-4 | — | 37 | 31 |
|  | 5 g · L-1 | 41 | 159 |
| YA5215-1 | — | 40 | 26 |
|  | 1 g · L-1 | 50 | 43 |
|  | 2 g · L-1 | 51 | 76 |
|  | 5 g · L-1 | 46 | 159 |
| YA5215-2 | — | 38 | 27 |
|  | 5 g · L-1 | 50 | 162 |

Example 8: Replacement of Yeast Native GAPDH Genes by Gdp1 from *Kluyveromyces lactis* to Favor Reaching a Neutral Redox Balance of a 1-Propanol and Acetone Co-Production Pathway As described in the [208] there are metabolic engineering ways to generate anaerobic strains for the co-production of 1-propanol and acetone with neutral redox balance. It is described here an example, which is the replacement of Glyceraldehyde-3-phosphate dehydrogenase (GAPDH) of *Saccharomyces cerevisiae*, encoding by 3 genes (TDH1, TDH2 and TDH3), an enzyme with strict requirement for the oxidized NAD+ cofactor by GAPDH (encoded by GDP1.K1) from crabtree negative yeast *Kluyveromyces lactis*, which accepts either NAD+ or NADP+ and also displays a similar affinity for both compounds.

To determine the minimal GAPDH activity required to sustain an adequate carbon flux towards PEP, the contribution of each of the three yeast GAPDH isozymes was assayed in both a wild type and mutant strains. As the TDH1Δ, TDH2Δ, TDH3Δ triple mutant yeast cells were not viable, strains bearing either single or double TDH deletions were engineered and the GAPDH activity was assayed within crude extract of the resulting strains.

TABLE 43

Strains constructed to test TDHs activity.

| Strain | Relevant Genotype |
|---|---|
| YA4693-1A | ade2, his3, leu2, tdh1::URA3.Sba-loxP, tdh3::LEU2.K1-loxP, trp1, ura3 |
| YA4693-1B | ade2, his3, leu2, tdh1::URA3.Sba-loxP, tdh2::HIS5.Sp-loxP, trp1, ura3 |
| YA4693-1D | ade2, his3, leu2, tdh2::HIS5.Sp-loxP, trp1, ura3 |
| YA4693-2D | ade2, his3, leu2, tdh1::URA3.Sba-loxP, trp1, ura3 |
| YA4693-3D | ade2, his3, leu2, tdh2::HIS5.Sp-loxP, tdh3::LEU2.K1-loxP, trp1, ura3 |
| YA4693-4C | ade2, his3, leu2, tdh3::LEU2.K1-loxP, trp1, ura3 |

TDH3 activity assay is as described in Nakajima H, Itakura M, Kubo T, Kaneshige A, Harada N, Izawa T, Azuma Y T, Kuwamura M, Yamaji R, Takeuchi T. (2017) J Biol Chem 292(11):4727-4742

TABLE 44

Activity of GAPDH isozymes to NAD consumption.

| Strain | Active genes | Activity (nmol · min$^{-1}$ · mg$^{-1}$) NAD |
|---|---|---|
| Wild type | TDH1, TDH2, TDH3 | 24000 |
| YA4693-2D | TDH2, TDH3 | 24000 |
| YA4693-1D | TDH1, TDH3 | 24000 |
| YA4693-4C | TDH1, TDH2 | 6000 |
| YA4693-1B | TDH3 | 24000 |
| YA4693-1A | TDH2 | 6000 |
| YA4693-3D | TDH1 | 3500 |

Deletion of TDH3 leads to a 4-fold decrease of GAPDH activity. TDH1, TDH2 or both TDH1 and TDH2 had no effect on GAPDH activity and deletion of both TDH2 and TDH3 led to an 8-fold activity decrease. It is also important to note that TDH3 gene is responsible for most of the GAPDH activity in yeast cells.

To measure the activity of the *Kluyveromyces lactis* GAPDH enzyme, GDP1.K1 was expressed under the control of a strong promoter in a TDH1 deleted strain and compared with wild type cells.

TABLE 45

Strain constructed to measure the GDP1.Kl activity.

| Strain | Relevant Genotype |
|---|---|
| YA4807-1 | MAT-a, ade2, his3, leu2, tdh2::loxP, tdh3::loxP, trp1, ura3 |
| YA4857-3 | ade2, his3, jlp1::[ADE2.Sba-loxP-GDP1.Kl], leu, tdh2::loxP, thd3::loxP, trp1, ura3 |
| YA4915-25C | tdh1::loxP, tdh2::loxP, tdh3::loxP, ura3::[GDP1.Kl-URA3]x8 |
| YA4918-67C | tdh1::loxP, tdh2::loxP, tdh3::loxP, ura3::[GDP1.Kl-URA3]x11 |

TABLE 46

Activity of GDP1.Kl to co-factor consumption

| Strain | Active genes | Activity (nmol · min$^{-1}$ · mg$^{-1}$) | |
|---|---|---|---|
| | | NAD | NADP |
| Wild type | TDH1, TDH2, TDH3 | 24000 | 0 |
| YA4807-1 | TDH1 | 3200 | Not detected |
| YA4857-3 | TDH1 + pStrong-GDP1.Kl | 7500 | 2800 |
| YA4915-25C | [pStrong-GDP1.Kl] x8 | 25000 | 32000 |
| YA4918-67C | [pStrong-GDP1.Kl] x11 | 35000 | 47000 |

Expressed in *Saccharomyces cerevisiae* cells, GDP1.K1 consumed either NAD+ or NADP+. This activity appears to be strong to complement the deletion of the three *S. cerevisiae* TDH genes with the increment of the copy number of GDP1.K1.

Besides, the replacement of GAPDH in combination with the use of HPD1 enzyme (*Candida albicans*), that catalyzes the conversion of malonate semialdehyde to 3-hydroxypropionic acid (3-HP), can be used to reaching neutral redox balance.

Example 9: Co-Production of 1-Propanol and Acetone

As described on previous examples, the in-vivo production of 3-HP, MSA and acetone have been demonstrated from glucose through the B-alanine route. Besides, the in-vivo conversion of 3HP into 1-propanol has been successfully demonstrated too supplementing culture media with 1-5 g/L 3HP. Considering engineered variants of oxaloacetate decarboxylase have increased activity for the conversion of oxaloacetate into malonate semialdehyde, it is expected that such enhanced oxaloacetate decarboxylase engineered variants are able to sustain the production of malonate semialdehyde and malonate semialdehyde-derivatives such as 1-propanol from glucose fermentation. For example, one of the best engineered oxaloacetate decarboxylase variants showed to be 4-5× lower only compared to PAND enzyme (panD, *Tribolium castaneum*), that catalyzes the aspartate conversion to β-alanine, under in-vitro enzymatic experiment, indicating such engineered variant would sustain in-vivo production of 3-HP from glucose (data not shown).

Based on the information here disclosed, an engineered microbial strain can be generated to co-produce 1-propanol and acetone by introducing for example the target 1-propanol pathway enzymes into an already acetone-producing engineered strain such as the ones previously described. Besides, it's been successfully demonstrated previously the in-vivo production of 3-HP from glucose through the β-alanine pathway under anaerobic fermentation conditions. So, it is expected that such 3HPA-producing strain starts to co-produce 1-propanol and acetone after introducing both target enzymes of the 1-propanol and acetone pathways.

For example, such 1-propanol and acetone co-producing engineered strains could be grown in 25 mL of rich medium in the presence of 4% glucose in Erlenmeyer flasks with or without silicon cap plus two 1 mL pipette tip with filter. After 24 h of culture, another amount of 4% glucose is added. Stirring is maintained at 135 rpm (50 mm shaking diameter). The presence of 1-propanol and acetone into the culture medium is measured by standard GC/MS-MS head space analysis.

Example 10: Co-Production of 1-Propanol and 2-Propanol

As described on Example 9, an engineered microbial strain can be generated to co-produce 1-propanol and acetone by introducing for example the target 1-propanol pathway enzymes into an already acetone-producing engineered strain such as the ones previously described. Besides, it is been successfully demonstrated previously the in-vivo production of 3-HP from glucose through the β-alanine pathway under anaerobic fermentation conditions. So, it is expected that such 3HPA-producing strain starts to co-produce 1-propanol and acetone after introducing both target enzymes of the 1-propanol and acetone pathways. Then, to co-produce 1-propanol and 2-propanol, the 2-propanol dehydrogenase, for example as listed in Table 15, can be introduced on strain described on example 9.

To evaluate 1-propanol and 2-propanol co-production, the strains could be grown in 25 mL of rich medium in the presence of 4% glucose in Erlenmeyer flasks with or without silicon cap plus two 1 mL pipette tip with filter. After 24 h of culture, another amount of 4% glucose is added. Stirring is maintained at 135 rpm (50 mm shaking diameter). The presence of 1-propanol and 2-propanol into the culture medium is measured by standard GC/MS-MS head space analysis.

NUMBERED EMBODIMENTS

Embodiment 1

A recombinant microorganism capable of co-producing 3-hydroxypropionic acid (3-HP) and acetyl-CoA, and/or derivatives thereof, from a feedstock comprising one or more carbon sources, wherein the recombinant microorganism comprises one or more of the following:
(a) at least one endogenous and/or exogenous nucleic acid molecule encoding a 3-hydroxypropionic acid dehydrogenase that catalyzes the production of 3-HP from malonate semialdehyde;
(b) at least one endogenous and/or exogenous nucleic acid molecule encoding a
  (i) malonate semialdehyde dehydrogenase that catalyzes the production of acetyl-CoA from malonate semialdehyde, and/or
  (ii) malonyl-CoA reductase and/or 2-keto acid decarboxylase that catalyzes the conversion of malonate semialdehyde into malonyl-CoA, and malonyl-CoA decarboxylase that catalyzes the production of acetyl-CoA from malonyl-CoA;
(c) at least one endogenous and/or exogenous nucleic acid molecule encoding an enzyme that is able to catalyze the decarboxylation of oxaloacetate into malonate semialdehyde.

Embodiment 2

The recombinant microorganism of embodiment 1, wherein the recombinant microorganism is capable of producing 1-propanol.

Embodiment 3

The recombinant microorganism of embodiment 2, wherein the recombinant microorganism comprises one or more of the following:
(a) at least one endogenous and/or exogenous nucleic acid molecule encoding a propionyl-CoA synthase that catalyzes the conversion of 3-HP into propionyl-CoA;
(b) at least one endogenous and/or exogenous nucleic acid molecule encoding a 3-hydroxypropionyl-CoA synthetase/CoA transferase, 3-hydroxypropionyl-CoA dehydratase, and acrylyl-CoA reductase that catalyzes the conversion of 3-HP into propionyl-CoA;
(c) at least one endogenous and/or exogenous nucleic acid molecule encoding an alcohol/aldehyde dehydrogenase that catalyzes the conversion of propionyl-CoA from (a) or (b) into 1-propanol, or an aldehyde dehydrogenase (acetylating) and alcohol dehydrogenase that catalyzes together the production of 1-propanol from propionyl-CoA.

Embodiment 4

The recombinant microorganism of embodiment 1, wherein the recombinant microorganism is capable of producing acetone.

Embodiment 5

The recombinant microorganism of embodiment 4, wherein the recombinant microorganism comprises one or more of the following:

(a) at least one endogenous and/or exogenous nucleic acid molecule encoding a thiolase or an acetyl-CoA acetyltransferase that catalyzes the production of acetoacetyl-CoA from acetyl-CoA;
(b) at least one endogenous and/or exogenous nucleic acid molecule encoding an acetoacetyl-CoA synthase that catalyzes the production of acetoacetyl-CoA from malonyl-CoA;
(c) at least one endogenous and/or exogenous nucleic acid molecule encoding an acetoacetyl-CoA transferase that catalyzes the production of acetoacetate from acetoacetyl-CoA;
(d) at least one endogenous and/or exogenous nucleic acid molecule encoding a
  (i) hydroxymethylglutaryl-CoA synthase that catalyzes the production of HMG-CoA from acetoacetyl-CoA, and
  (ii) hydroxymethylglutaryl-CoA lyase that catalyzes the production of acetoacetate from HMG-CoA; and
(e) at least one endogenous and/or exogenous nucleic acid molecule encoding an acetoacetate decarboxylase that catalyzes the production of acetone from acetoacetate.

Embodiment 6

The recombinant microorganism of embodiment 5, wherein the endogenous and/or exogenous nucleic acid molecule encoding a thiolase or an acetyl-CoA acetyltransferase encodes an amino acid sequence comprising ERG10 (SEQ ID NO: 209), thlA (SEQ ID NO: 210), atoB (SEQ ID NO: 211), H16_B0759 (SEQ ID NO: 212), Msed_0656 (SEQ ID NO: 213), or AAT1 (SEQ ID NO: 214).

Embodiment 7

The recombinant microorganism of embodiment 6, wherein the endogenous and/or exogenous nucleic acid molecule encoding a thiolase or an acetyl-CoA acetyltransferase encode an amino acid sequence comprising ERG10 (SEQ ID NO: 209).

Embodiment 8

The recombinant microorganism of embodiment 5, wherein the endogenous and/or exogenous nucleic acid molecule encoding an acetoacetyl-CoA synthase encodes an amino acid sequence comprising nphT7 (SEQ ID NO: 285).

Embodiment 9

The recombinant microorganism of embodiment 5, wherein the endogenous and/or exogenous nucleic acid molecule encoding a acetoacetyl-CoA transferase encodes an amino acid sequence comprising atoA/atoD (SEQ ID NO: 215 and 216), ctfA/ctfB (SEQ ID NO: 219 and 220), ctfA/ctfB (SEQ ID NO:221 and 222) or ctfA/ctfB (SEQ ID NO:223 and 224).

Embodiment 10

The recombinant microorganism of embodiment 9, wherein the endogenous and/or exogenous nucleic acid molecule encoding an acetoacetyl-CoA transferase encodes an amino acid sequence comprising atoA/atoD (SEQ ID NO: 215 and 216)

Embodiment 11

The recombinant microorganism of embodiment 5, wherein the endogenous and/or exogenous nucleic acid molecule encoding a hydroxymethylglutaryl-CoA synthase and a hydroxymethylglutaryl-CoA lyase encode an amino acid sequence comprising ERG13 (SEQ ID NO: 283) and yngG (SEQ ID NO: 284).

Embodiment 12

The recombinant microorganism of embodiment 5, wherein the endogenous and/or exogenous nucleic acid molecule encoding a acetoacetate decarboxylase encodes an amino acid sequence comprising Adc.Ca (SEQ ID NO: 225), Adc.Cbe (SEQ ID NO: 226), Adc (SEQ ID NO: 227), Adc (SEQ ID NO: 228), Adc (SEQ ID NO: 229) or Adc.Pp (SEQ ID NO: 230).

Embodiment 13

The recombinant microorganism of embodiment 12, wherein the endogenous and/or exogenous nucleic acid molecule encoding a acetoacetate decarboxylase encodes an amino acid sequence comprising Adc.Pp (SEQ ID NO: 230).

Embodiment 14

The recombinant microorganism of embodiment 1, wherein the recombinant microorganism catalyzes malonate semialdehyde for the production of both 3-HP and acetyl-CoA, and/or derivatives thereof.

Embodiment 15

The recombinant microorganism of embodiment 1, wherein the derivatives of 3-HP are selected from the group consisting of: acrylic acid, 1-propanol, propene, and polypropylene.

Embodiment 16

The recombinant microorganism of embodiment 1, wherein the derivatives of acetyl-CoA are selected from the group consisting of: acetone, 2-propanol, propene, and polypropylene.

Embodiment 17

The recombinant microorganism of embodiment 1, wherein the microorganism is selected from a bacterium, a fungus, or a yeast.

Embodiment 18

The recombinant microorganism of embodiment 1, wherein the recombinant microorganism is derived from a parental microorganism selected from the group consisting of: *Clostridium sp., Clostridium ljungdahlii, Clostridium autoethanogenum, Clostridium ragsdalei, Eubacterium limosum, Butyribacterium methylotrophicum, Moorella thermoacetica, Clostridium aceticum, Acetobacterium woodii, Alkalibaculum bacchii, Clostridium drakei, Clostridium carboxidivorans, Clostridium formicoaceticum, Clostridium scatologenes, Moorella thermoautotrophica, Acetonema longum, Blautia producta, Clostridium glycolicum, Clostridium magnum, Clostridium mayombei, Clostridium methoxybenzovorans, Clostridium acetobutylicum, Clostridium beijerinckii, Oxobacter pfennigii, Thermoanaerobacter kivui, Sporomusa ovata, Thermoacetogenium phaeum, Acetobacterium carbinolicum, Sporomusa ter-*

*mitida, Moorella glycerini, Eubacterium aggregans, Treponema azotonutricium, Escherichia coli, Saccharomyces cerevisiae, Pseudomonas putida, Bacillus* sp, *Corynebacterium* sp., *Yarrowia lipolytica, Scheffersomyces stipitis,* and *Terrisporobacter glycolicus.*

Embodiment 19

The recombinant microorganism of embodiment 17, wherein the recombinant microorganism is a yeast.

Embodiment 20

The recombinant microorganism of embodiment 19, wherein the yeast is *Saccharomyces cerevisiae.*

Embodiment 21

The recombinant microorganism of embodiment 19, wherein the yeast is capable of aerobic and anaerobic production.

Embodiment 22

The recombinant microorganism of embodiment 14, wherein the recombinant microorganism comprises a decarboxylase capable of acting on oxaloacetate to produce malonate semialdehyde.

Embodiment 23

A method of producing 3-hydroxypropionic acid (3-HP) and acetyl-CoA, and/or derivatives thereof, the method comprising culturing the recombinant microorganism in a culture medium containing a feedstock comprising a carbon source until the 3-hydroxypropionic acid (3-HP) and acetyl-CoA, and/or derivatives thereof, are produced.

Embodiment 24

A method of producing a recombinant microorganism capable of co-producing 3-hydroxypropionic acid (3-HP) and acetyl-CoA, and/or derivatives thereof, from a feedstock comprising one or more carbon sources, the method comprising introducing into and/or overexpressing in the recombinant microorganism one or more of the following:
(a) at least one endogenous and/or exogenous nucleic acid molecule encoding a 3-hydroxypropionic acid dehydrogenase that catalyzes the production of 3-HP from malonate semialdehyde;
(b) at least one endogenous and/or exogenous nucleic acid molecule encoding a
  (i) malonate semialdehyde dehydrogenase that catalyzes the production of acetyl-CoA from malonate semialdehyde, and/or
  (ii) malonyl-CoA reductase and/or 2-keto acid decarboxylase that catalyzes the conversion of malonate semialdehyde into malonyl-CoA, and malonyl-CoA decarboxylase that catalyzes the production of acetyl-CoA from malonyl-CoA;
(c) at least one endogenous and/or exogenous nucleic acid molecule encoding an enzyme that is able to catalyze the decarboxylation of oxaloacetate into malonate semialdehyde.

Embodiment 25

The method of embodiment 24, wherein the recombinant microorganism is capable of producing 1-propanol.

Embodiment 26

The method of embodiment 24, wherein the method further comprises introducing into and/or overexpressing in the recombinant microorganism one or more of the following:
(a) at least one endogenous and/or exogenous nucleic acid molecule encoding a propionyl-CoA synthase that catalyzes the conversion of 3-HP into propionyl-CoA;
(b) at least one endogenous and/or exogenous nucleic acid molecule encoding a 3-hydroxypropionyl-CoA synthetase/CoA transferase, 3-hydroxypropionyl-CoA dehydratase, and acrylyl-CoA reductase that catalyzes the conversion of 3-HP into propionyl-CoA;
(c) at least one endogenous and/or exogenous nucleic acid molecule encoding an alcohol/aldehyde dehydrogenase that catalyzes the conversion of propionyl-CoA from (a) or (b) into 1-propanol, or an aldehyde dehydrogenase (acetylating) and alcohol dehydrogenase that catalyzes together the production of 1-propanol from propionyl-CoA.

Embodiment 27

The method of embodiment 24, wherein the recombinant microorganism is capable of producing acetone.

Embodiment 28

The method of embodiment 27, wherein the method further comprises introducing into and/or overexpressing in the recombinant microorganism one or more of the following:
(a) at least one endogenous and/or exogenous nucleic acid molecule encoding a thiolase or an acetyl-CoA acetyltransferase that catalyzes the production of acetoacetyl-CoA from acetyl-CoA;
(b) at least one endogenous and/or exogenous nucleic acid molecule encoding an acetoacetyl-CoA synthase that catalyzes the production of acetoacetyl-CoA from malonyl-CoA;
(c) at least one endogenous and/or exogenous nucleic acid molecule encoding an acetoacetyl-CoA transferase that catalyzes the production of acetoacetate from acetoacetyl-CoA;
(d) at least one endogenous and/or exogenous nucleic acid molecule encoding a
  (i) hydroxymethylglutaryl-CoA synthase that catalyzes the production of HMG-CoA from acetoacetyl-CoA, and
  (ii) hydroxymethylglutaryl-CoA lyase that catalyzes the production of acetoacetate from HMG-CoA; and
(e) at least one endogenous and/or exogenous nucleic acid molecule encoding an acetoacetate decarboxylase that catalyzes the production of acetone from acetoacetate.

Embodiment 29

The method of embodiment 24, wherein the recombinant microorganism catalyzes malonate semialdehyde for the production of both 3-HP and acetyl-CoA, and/or derivatives thereof.

Embodiment 30

The method of embodiment 24, wherein the derivatives of 3-HP are selected from the group consisting of: acrylic acid, 1-propanol, propene, and polypropylene.

Embodiment 31

The method of embodiment 24, wherein the derivatives of acetyl-CoA are selected from the group consisting of: acetone, 2-propanol, propene, and polypropylene.

Embodiment 32

The method of embodiment 24, wherein the microorganism is selected from a bacterium, a fungus, or a yeast.

Embodiment 33

The method of embodiment 24, wherein the recombinant microorganism is derived from a parental microorganism selected from the group consisting of: *Clostridium* sp., *Clostridium ljungdahlii*, *Clostridium autoethanogenum*, *Clostridium ragsdalei*, *Eubacterium limosum*, *Butyribacterium methylotrophicum*, *Moorella thermoacetica*, *Clostridium aceticum*, *Acetobacterium woodii*, *Alkalibaculum bacchii*, *Clostridium drakei*, *Clostridium carboxidivorans*, *Clostridium formicoaceticum*, *Clostridium scatologenes*, *Moorella thermoautotrophica*, *Acetonema longum*, *Blautia producta*, *Clostridium glycolicum*, *Clostridium magnum*, *Clostridium mayombei*, *Clostridium methoxybenzovorans*, *Clostridium acetobutylicum*, *Clostridium beijerinckii*, *Oxobacter pfennigii*, *Thermoanaerobacter kivui*, *Sporomusa ovata*, *Thermoacetogenium phaeum*, *Acetobacterium carbinolicum*, *Sporomusa termitida*, *Moorella glycerini*, *Eubacterium aggregans*, *Treponema azotonutricium*, *Escherichia coli*, *Saccharomyces cerevisiae*, *Pseudomonas putida*, *Bacillus* sp, *Corynebacterium* sp., *Yarrowia lipolytica*, *Scheffersomyces stipitis*, and *Terrisporobacter glycolicus*.

Embodiment 34

The method of embodiment 32, wherein the recombinant microorganism is a yeast.

Embodiment 35

The method of embodiment 34, wherein the yeast is *Saccharomyces cerevisiae*.

Embodiment 36

The method of embodiment 34, wherein the recombinant microorganism co-produces 3-HP, and/or derivatives and Acetyl-CoA and/or derivatives, in an aerobic, microanaerobic or anaerobic production process, preferably an anaerobic process.

Embodiment 37

The method of embodiment 29, wherein the recombinant microorganism comprises a decarboxylase capable of acting on oxaloacetate to produce malonate semialdehyde.

Embodiment 38

The method of embodiment 24, wherein at least a portion of excess NAD(P)H produced in the production of acetyl-CoA is utilized as a source of reducing equivalents in the production of 3-HP and/or derivatives thereof.

Embodiment 39

The recombinant microorganism of embodiment 1, wherein at least a portion of excess NAD(P)H produced in the production of acetyl-CoA is utilized as a source of reducing equivalents in the production of 3-HP and/or derivatives thereof.

Embodiment 40

A recombinant microorganism capable of co-producing 3-hydroxypropionic acid (3-HP) and acetyl-CoA, and/or derivatives thereof, from a feedstock comprising one or more carbon sources, wherein the recombinant microorganism comprises one or more of the following:
(a) at least one endogenous and/or exogenous nucleic acid molecule encoding an 3-hydroxypropionic acid dehydrogenase that catalyzes the production of 3-HP from malonate semialdehyde;
(b) at least one endogenous and/or exogenous nucleic acid molecule encoding a
   (i) malonate semialdehyde dehydrogenase that catalyzes the production of acetyl-CoA from malonate semialdehyde, and/or
   (ii) malonyl-CoA reductase and/or 2-keto acid decarboxylase that catalyzes the conversion of malonate semialdehyde into malonyl-CoA, and malonyl-CoA decarboxylase that catalyzes the production of acetyl-CoA from malonyl-CoA; and
(c) at least one endogenous and/or exogenous nucleic acid molecule encoding an aspartate amino transferase, aspartate decarboxylase, β-alanine pyruvate amino transferase and/or β-alanine transaminase that catalyze the production of malonate semialdehyde from oxaloacetate, having beta-alanine as an intermediate.

Embodiment 41

The recombinant microorganism of embodiment 40, wherein the recombinant microorganism is capable of producing 1-propanol wherein the recombinant microorganism comprises one or more of the following:
(a) at least one endogenous and/or exogenous nucleic acid molecule encoding a propionyl-CoA synthase that catalyzes the production of propionyl-CoA from 3-HP;
(b) at least one endogenous and/or exogenous nucleic acid molecule encoding a 3-hydroxypropionyl-CoA synthetase, 3-hydroxypropionyl-CoA dehydratase, and acrylyl-CoA reductase that catalyzes the production of propionyl-CoA from 3-HP; and
(c) at least one endogenous and/or exogenous nucleic acid molecule encoding an alcohol/aldehyde dehydrogenase that catalyzes the production of 1-propanol from propionyl-CoA.

Embodiment 42

The recombinant microorganism of embodiment 40, wherein the recombinant microorganism is capable of producing acetone wherein the recombinant microorganism comprises one or more of the following:
(a) at least one endogenous and/or exogenous nucleic acid molecule encoding a thiolase or an acetyl-CoA acetyltransferase that catalyzes the production of acetoacetyl-CoA from acetyl-CoA;

(b) at least one endogenous and/or exogenous nucleic acid molecule encoding an acetoacetyl-CoA synthase that catalyzes the production of acetoacetyl-CoA from malonyl-CoA;
(c) at least one endogenous and/or exogenous nucleic acid molecule encoding an acetoacetyl-CoA transferase that catalyzes the production of acetoacetate from acetoacetyl-CoA;
(d) at least one endogenous and/or exogenous nucleic acid molecule encoding a
  (i) hydroxymethylglutaryl-CoA synthase that catalyzes the production of HMG-CoA from acetoacetyl-CoA, and
  (ii) hydroxymethylglutaryl-CoA lyase that catalyzes the production of acetoacetate from HMG-CoA; and
(e) at least one endogenous and/or exogenous nucleic acid molecule encoding an acetoacetate decarboxylase that catalyzes the production of acetone from acetoacetate.

Embodiment 43

The recombinant microorganism of embodiments 40 through 42, wherein the derivatives of 3-HP are selected from the group consisting of: acrylic acid, 1-propanol, propene, and polypropylene.

Embodiment 44

The recombinant microorganism of embodiments 40 through 42, wherein the derivatives of acetyl-CoA are selected from the group consisting of: acetone, 2-propanol, propene, and polypropylene.

Embodiment 45

A recombinant microorganism capable of producing acetone and/or derivatives thereof, from a feedstock comprising one or more carbon sources, wherein the recombinant microorganism comprises one or more of the following:
(a) at least one endogenous and/or exogenous nucleic acid molecule encoding:
  (i) at least one endogenous and/or exogenous nucleic acid molecule encoding an enzyme that is able to catalyze the decarboxylation of oxaloacetate into malonate semialdehyde or
  (ii) at least one endogenous and/or exogenous nucleic acid molecule encoding an aspartate amino transferase, aspartate decarboxylase, β-alanine pyruvate amino transferase and/or β-alanine transaminase that catalyze the production of malonate semialdehyde from oxaloacetate, having beta-alanine as an intermediate,
  (iii) malonate semialdehyde dehydrogenase that catalyzes the production of acetyl-CoA from malonate semialdehyde from (i) or (ii), or
  (iv) malonyl-CoA reductase and/or 2-keto decarboxylase that catalyzes the conversion of malonate semialdehyde from (i) or (ii) into malonyl-CoA, and malonyl-CoA decarboxylase that catalyzes the production of acetyl-CoA from malonyl-CoA
(b) at least one or more endogenous and/or exogenous nucleic acid molecules capable of catalyze the conversion of acetyl-CoA to acetone.

Embodiment 46

The recombinant microorganism of embodiment 45, wherein the recombinant microorganism further comprises one or more of the following:

(a) at least one endogenous and/or exogenous nucleic acid molecule encoding a thiolase or an acetyl-CoA acetyltransferase that catalyzes the production of acetoacetyl-CoA from acetyl-CoA;
(b) at least one endogenous and/or exogenous nucleic acid molecule encoding an acetoacetyl-CoA synthase that catalyzes the production of acetoacetyl-CoA from malonyl-CoA;
(c) at least one endogenous and/or exogenous nucleic acid molecule encoding an acetoacetyl-CoA transferase that catalyzes the production of acetoacetate from acetoacetyl-CoA;
(d) at least one endogenous and/or exogenous nucleic acid molecule encoding a
  (i) hydroxymethylglutaryl-CoA synthase that catalyzes the production of HMG-CoA from acetoacetyl-CoA, and
  (ii) hydroxymethylglutaryl-CoA lyase that catalyzes the production of acetoacetate from HMG-CoA; and
(e) at least one endogenous and/or exogenous nucleic acid molecule encoding an acetoacetate decarboxylase that catalyzes the production of acetone from acetoacetate.

Embodiment 47

The recombinant microorganism of embodiment 46, wherein the derivatives of acetone are selected from the group consisting of: 2-propanol, propene, and polypropylene.

Embodiment 48

The recombinant microorganism of embodiment 46, wherein at least a portion of excess NAD(P)H produced in the production of acetone is utilized as a source of reducing equivalents on a coproducing pathway.

Embodiment 49

The recombinant microorganism of embodiment 48, wherein a co-producing pathway is a 3-HP pathway.

Embodiment 50

The recombinant microorganism of embodiments 40-48, wherein the recombinant microorganism produces acetone in an aerobic, microaerobic or anaerobic production process.

Embodiment 51

A method of co-producing 3-HP, and/or derivatives thereof and Acetyl-CoA and/or derivatives thereof by contacting the recombinant microorganism of any of the embodiments 1 with a fermentable carbon source under conditions and for a sufficient period of time to produce 3-HP, or derivatives and Acetyl-CoA or derivatives.

Embodiment 52

A method of producing Acetone or derivatives by contacting the recombinant microorganism of embodiment with a fermentable carbon source under conditions and for a sufficient period of time to produce acetone or derivatives.

Embodiment 53

The methods of embodiments 51 or 52, wherein the carbon source is selected from sugars, glycerol, alcohols, organic acids, alkanes, fatty acids, lignocellulose, proteins, carbon dioxide, and carbon monoxide.

Embodiment 54

The recombinant microorganism of embodiments 51 or 52, wherein the recombinant microorganism produces acetone in an aerobic, microaerobic or anaerobic production process.

INCORPORATION BY REFERENCE

All references, articles, publications, patents, patent publications, and patent applications cited herein are incorporated by reference in their entireties for all purposes. However, mention of any reference, article, publication, patent, patent publication, and patent application cited herein is not, and should not be taken as, an acknowledgment or any form of suggestion that they constitute valid prior art or form part of the common general knowledge in any country in the world. Further, the following references are hereby incorporated by reference:

SEQUENCE LISTING (285 sequences)

SEQ ID NO: 1 - protein, 528 aa, Artificial Sequence
  Modified amino acid sequence of the enzymes able to catalyze the decarboxylation of oxaloacetate into malonic semi-aldehyde
  Variant (109)..(109): Xaa in position 109 is selected from the group consisting of leucine, lysine, arginine and valine
  Variant (110)..(110): Xaa in position 110 is selected from the group consisting of leucine and lysine
  Variant (377)..(377): Xaa in position 377 is selected from the group consisting of threonine and serine
  Variant (397)..(397): Xaa in position 397 is selected from the group consisting of phenylalanine, asparagine, alanine, isoleucine and valine
  Variant (398)..(398): Xaa in position 398 is selected from the group consisting of cysteine and arginine
  Variant (403)..(403): Xaa in position 403 is selected from the group consisting of leucine, asparagine and alanine
  Variant (460)..(460): Xaa in position 460 is selected from the group consisting of alanine and leucine
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEAXXTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESXSTTAQMWQRLNMRNPGSYYXXAAGGXGFALPAAIGVQLAEPERQVIAVIGDGSANYSISALWTAAQYNIPTIFVIMNNGTYGXLRWFAGVLEAENVPGLDVPGIDFRALAKGYGVQALKADNLEQLKGSLQEALSAKGPVLIEVSTVSPVK

SEQ ID NO: 2 - protein, 528 aa, Artificial Sequence
  Modified Enzyme No. 2
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 3 - protein, 528 aa, Artificial Sequence
  Modified Enzyme No. 2
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYNCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 4 - protein, 528 aa, Artificial Sequence
  Modified Enzyme No. 3
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEAKLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYNCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 5 - protein, 528 aa, Artificial Sequence
  Modified Enzyme No. 4
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYNCAAGGLGFALPAAIGVQLAEPERQVIAVIGDGSANYSISALWTAAQYNIPTIFVIMNNGTYGLLRWFAGVLEAENVPGLDVPGIDFRALAKGYGVQALKADNLEQLKGSLQEALSAKGPVLIEVSTVSPVK

SEQ ID NO: 6 - protein, 528 aa, Artificial Sequence
  Modified Enzyme No. 5
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEAVKTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYNCAAGGNGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 7 - protein, 248 aa, Escherichia coli
MIVLVTGATAGFGECITRRFIQQGHKVIATGRRQERLQELKDELGDNLYIAQLDVRNRAAIEEMLASLPAEWCNIDILVNNAGLALGMEPAHKASVEDWETMIDTNNKGLVYMTRAVLPGMVERNHGHIINIGSTAGSWPYAGGNVYGATKAFVRQFSLNLRTDLHGTAVRVTDIEPGLVGGTEFSNVRFKGDDGKAEKTYQNTVALTPEDVSEAVWWVSTLPAHVNINTLEMMPVTQSYAGLNVHRQ

SEQ ID NO: 8 - protein, 1824 aa, Chloroflexus aggregans
MAIDTAPPAPSRAPRSNPIRDRVDWETQRAAALANPGAFHGAIARTVIHWYDPKHNCWIRFDESSQRWEGLDAATGAPVTVDYPADYQPWQQAFDDSEAPFYRWFYGGLTNACFNEVDRHVMMGYGDEVAYYFEGDRWDNSLNNGRGGPVVQETITRRRLLVEVVKAAQVLRDLGLKKGDRIALNMPNIMPQIYYTEAAKRLGIIYTPVFGGFSDKTLSDRIHNAGARVVITSDGAYRNAQVVPYKEAYTDQALDKYVPVETVRRIVAETLTTLPLRDDQRQKIIDEVESVLSGEITIERSDVMRGVGAALAQIRDLDAATQANVRTVLAQALVASPPRVEAVIVVRHTGQDILWNADRDRWSHELLEAALAKILANARAIGIDVHSEADLLKLPDDQLIRALYASVPCEPVDAEYPMFIIYTSGSTGKPKGVIHVHGGYVSGVVHTLRVSFDAEPGDTIYVIADPGWITGQSYMLTATMAGRLTGIIAEGSPLFPSSGRYASIIERYGVQIFKAGVTFLKTVMSNPQNIEDVRLYNMSSLRVATFCAEPVSPAVQQFGMQIMTPQYINSYWATEHGGIVWTHFYGNNDFPLRPDAHTYPLPWVAGDVWVAETDESGNVRYRVADYEEKGEIVITAPYPYLTRTIWGDVPGFEAYLRGEIPLKAWKGDAERFIKTYWRRGPHGEWGYIQGDFAMKYPDGSFTLHGRSDDVINVSGHRMGTEEIEGAILRDRQITPDSPVGNCIVVGAPHREKGLTPVAFIQPAPGRRLTAADRRRLDELVRTEKGAVSVPEDYIEVSAFPETRSGKYMRRFLRNMMLDEPLGDTTTLRNPEVLEEIAAKIAEWKRKQRLAEEQQIIERYRYFRIEYHPPAASAGKLAVVTVTNPPVNALNERALDELNTIVDHLSRRNDVAAIVFTGQGAKSFVAGADIRQLLEEIHTVEEAMALPNNAHLAFRKIERMNKPCIAAINGVALGGGLEFAMACHYRVADVYAEFGQPEINLRLLPGYGGTQRLPRLLHRRSNGTGLLRALEMILGGRSVPADEALELGLIDAIATGDADALMLACSLAREAIASDGTLREDAAVTKAFRQRHAQLEEWRKPDPHFTDDQLRSIIAHPRIERIIKQAHTVGRDVAVHRALDAIRYGFIHGFEAGLEHEAKLFAEAVVDPNGGKRGIREFLDRHSAPLPTRRPLISREQEQLLLEQKELLPIGSPFFPGVDRIPKWQYAQAFIRDPETGAAMHGDPIVAEKQIIIPVERPRANQALIYVLASEVNFNDIWAITGIPVSRFDEHDRDWHVTGSGGIGLVVALGEEARREGRLKIGDLVAIYSGQTDLLSPLMGLDPMAADFVIQGNDTPDGSHQQFMVAQAPQCMPVLPDMTLEAAGSYILNLGTIYRALFTTLRVQPGRTIFIEGAATGTGLDAVRTAARNGLNVIGMVSSPSRAATVLSAGGKGAINRKDPAIANCFTRVPEDPSEWAAWEAAGHPLLEMFRAQNGGRLADYVVSHAGETAFPRSFQLLGEPHDGHIPTLTFYGASSGYHFTFIGKPGAASPTEMLRRAGLRAGEGVLIYYGVGSPELIDGAGLEAIEAARLMGARIVVVTASDAQREFVLSLGFGAALRGVISITELKRRFGDEFDWPKTMPPLPDSRKDPQGLKEAVRRFNDLTFKPIGSAVGGFLRTPDNPRGYPDLIIERAGHDALAVSAMLIKPFTGRIVYFEDIGGRRYSFFAPQIWVRQRRIYMPTAQIFGTHLSNAYEIVRMNEEISAGLITITEPAVVPWDQLPEAHQAMWENRHTAATYVVNHALPRLGIKTKDELYEAWTAADRE

SEQ ID NO: 9 - protein, 1912 aa, Roseiflexus castenholzii
MTTIESALRPPRINPVRTRADWEAQRKAALTDPGAFHGAIARSAIHWYDRHLDAWITWDEEEGCWKGLRYSDGAPIDVPYGPDHEPWERAFNGDDPPFYRWFEGGLTNACFNEVDRHVLTGYGDEVAFYFEGDRWDSSLNNGRGGPVVSFAVTRKQLMLEVVKAAQVLRDLGLNMGDRIALNMPNIMEQLYYTEAAKRLGIIYTPVFGGFSDKTLSDRIHNAGARLVITSDGAYRNAQVVPYKEQYTDQALDKFVPVETALDIIEAALSGSEGSPVPGAPLLAPDQIKHILAQVRDALKEDITIERSDAMRAVGRAIEGLTGVDALAQSRARTAVAQALVNTPPRVDAVIVVRHTGQDILWRPERDRWSHELTARALETILANARAVGVEVYSEDELLNLPTDQFVKALYATSRAEPLDAEYPMFIIYTSGSTGKPKGVVHVHGGYVAGVAYTMRVSFDAEPGDTIYVVADPGWITGQSYMICATLTTRCTGIITEGSPVFPSAGRFASIIERYKVRIFKAGVTFLKTVMSDPQNTADARQYDMSSLRVCTFCAEPVSPAVQQFGMELMSPQYINSYWATEHGGIVWTHFYGNEDFPLRPDAHTYPLPWIAGEVWVLEGGDRDATGAEAPRYRIADYEEKGEIVITAPYPYLTRTIWGDVKGFEAWVAAMQHGNGATAPRWRGDAERFIKTYWRRGPNDEWGYIQGDFAMKYPDGSFTLHGRSDDVINVSGHRMGTEEIEGAILRDKIITPDSPVGNCIVVGAPHREKGLTPVAFILTAPGRKLTGEDRRRLNELVRNEKGAVSVPEDYIEVSAFPETRSGKYMRRFLRNLMLGEPLGDTTTLRNPESLKEIAEKIEAWKRKQRMAEEQRIFERYRYFRIEYHAVRERWTPSGNGSAAAEQKALTQRIAIVTVTNPPVNALNERALDELNTIVDHLARREDVAAVVFTGSGTKSFVAGADIKQMLEEMHTVEDAMALPNNAHLAFRKIETMNKPCIAAINGVALGGGMEFALACHYRIADLHAEFGQPEINLRLLPGYGGTQRLPRLLYSRRGEAGLIKALMIIMGGRTLNAERAYEIGLIDKVAHGHEEALTLATQMAREMILAERNGKPTELRVIPNTSDDPTTFFSPFHDPATAGEGLWPPLPEAYALRRQLTAQWETPDPAMVDLLEKALRDPLITRIINQAQWAGRARAIERIIDALRTGFTKGMLAGLEREARLFAEAVVAPDEGKIGIQDFLDKRSAPLPTRRRIHLTPDEEKRMIDAGMLLPIGAPFFPGVTPIPVAQYAMAVVRDEVTGAPAHGDPIEAEKQIIIPVEKPGPNDVLLYILASEVNFNDIWAITGVPVSQFDEHDRDWHVTGSGGIGLIVSVGEETKREGRLKVGDLVAIYSGQNDLLSPMVGLDPMAADFVIQGYNTPDASHQQFMVAQAPQCFPVLPDLTLEAAGSYMLNLGTVYRALFTTLKIQPGRRIFVEGAATGTGLDAARSAARNGLYVTGMVSSQERAAVVRAAGAVGVINRRDPRYAGIFTRVPEDPAKWAEWEAAGRPLLEDYRAQNGGHLADYAVSHAGETAFPRSFQLLGEPHDGHIPTLTFYGASSGYHFTFLGKPGAADPVEMLRRAGLRAGEAVMIYYGVDDRSYLGDEGYESGAVPETLERRTTLVDQVGLEAIESARAMGARIVVVTYTDAQREFVLSLGFGASLKGVVSLEELHRRYGDEFDWPETMPPLPDAKSDIHGFKAAVRRFNDLTFKPLGTAVGQFLRSNDNPRGYPDLIIERSGHDTLAVSVMLIKPFTGRVVYFENMDGQRYSFFAPQVWMRQRRIYMPTANIWGTHLSNAYEIVRLNDEISAGLLSITEPTLVEWNDLPQAHQAMWENRHQGATYVVNHALPRPGLKDKDELYEAWSEMLQNREYGV

SEQ ID NO: 10 - protein, 1823 aa, Chloroflexus aurantiacus
MAIDTAPLAPPRAPRSNPIRDRVDWEAQRAAALADPGAFHGAIARTVIHWYDPQHHCWIRFNESSQRWEGLDAATGAPVTVDYPADYQPWQQAFDDSEAPFYRWFSGGLTNACFNEVDRHVTMGYGDEVAYYFEGDRWDNSLNNGRGGPVVQETITRRRLLVEVVKAAQVLRDLGLKKGDRIALNMPNIMPQIYYTEAAKRLGILYTPVFGGFSDKTLSDRIHNAGARVVITSDGAYRNAQVVPYKEAYTDQALDKYIPVETAQAIVAQTLATLPLTESQRQTIITEVEAALAGEITVERSDVMRGVGSALAKLRDLDASVQAKVRTVLAQALVESPPRVEAVVVVRHTGQEILWNEGRDRWSHDLLDAALAKILANARAAGFDVHSENDLLNLPDDQLIRALYASIPCEPVDAEYPMFIIYTSGSTGKPKGVIHVHGGYVAGVVHTLRVSFDAEPGDTIYVIADPGWITGQSYMLTATMAGRLTGVIAEGSPLFPSAGRYASIIERYGVQIFKAGVTFLKTVMSNPQNVEDVRLYDMHSLRVATFCAEPVSPAVQQFGMQIMTPQYINSYWATEHGGIVWTHFYGNQDFPLRPDAHTYPLPWVMGDVWVAETDESGTTRYRVADFDEKGEIVITAPYPYLTRTLWGDVPGFEAYLRGEIPLRAWKGDAERFVKTYWRRGPNGEWGYIQGDFAIKYPDGSFTLHGRSDDVINVSGHRMGTEEIEGAILRDRQITPDSPVGNCIVVGAPHREKGLTPVAFIQPAPGRHLTGADRRRLDELVRTEKGAVSVPEDYIEVSAFPETRSGKYMRRFLRNMMLDEPLGDTTTLRNPEVLEEIAAKIAEWKRRQRMAEEQQIIERYRYFRIEYHPPTASAGKLAVVTVTNPPVNALNERALDELNTIVDHLARRQDVAAIVFTGQGARSFVAGADIRQLLEEIHTVEEAMALPNNAHLAFRKIERMNKPCIAAINGVALGGGLEFAMACHYRVADVYAEFGQPEINLRLLPGYGGTQRLPRLLYKRNNGTGLLRALEMILGGRSVPADEALELGLIDAIATGDQDSLSLACALARAAIGADGQLIESAAVTQAFRHRHEQLDEWRKPDPRFADDELRSIIAHPRIERIIRQAHTVGRDAAVHRALDAIRYGIIHGFEAGLEHEAKLFAEAVVDPNGGKRGIREFLDRQSAPLPTRRPLITPEQEQLLRDQKELLPVGSPFFPGVDRIPKWQYAQAVIRDPDTGAAAHGDPIVAEKQIIVPVERPRANQALIYVLASEVNFNDIWAITGIPVSRFDEHDRDWHVTGSGGIGLIVALGEEARREGRLKVGDLVAIYSGQSDLLSPLMGLDPMAADFVIQGNDTPDGSHQQFMLAQAPQCLPIPTDMSIEAAGSYILNLGTIYRALFTTLQIKAGRTIFIEGAATGTGLDAARSAARNGLRVIGMVSSSSRASTLLAAGAHGAINRKDPEVADCFTRVPEDPSAWAAWEAAGQPLLAMFRAQNDGRLADYVVSHAGETAFPRSFQLLGEPRDGHIPTLTFYGATSGYHFTFLGKPGSASPTEMLRRANLRAGEAVLIYYGVGSDDLVDTGGLEAIEAARQMGARIVVVTVSDAQREFVLSLGFGAALRGVVSLAELKRRFGDEFEWPRTMPPLPNARQDPQGLKEAVRRFNDLVFKPLGSAVGVFLRSADNPRGYPDLIIERAAHDALAVSAMLIKPFTGRIVYFEDIGGRRYSFFAPQIWVRQRRIYMPTAQIFGTHLSNAYEILRLNDEISAGLLTITEPAVVPWDELPEAHQAMWENRHTAATYVVNHALPRLGLKNRDELYEAWTAGER

SEQ ID NO: 11 - protein, 865 aa, Clostridium beijerinckii
MARVTNPEELTKRIEQIREAQREFAKFSQEEVDEIFRQAAMAANNARITLAKMAVEESGMGIVEDKVIKNHFAAEYIYNQYKDTKTCGVIERDEMFGITHIAEPIGVIAAIVPTTNPTSTAIFKTLIALKTRNGIIISPHPRAKNSTIAAAKIVLEAAERAGAPKGIIGWIDEPSIELSRNVMAESDIILATGGPGMVRAAYSSGKPAIGVGAGNTPAIIDDTAHIKMAVNSILLSKTFDNGVVCASEQSIIAMESVYDEVLKELDERGAYILKGDEVDKVRSIILDSKGSLNSEIVGQSAYKIAKMAGVEISEAVKVLIGEVESPELEEPFSHEKLSPILGMYKAKTFDDALRLASRMIELGGFGHTSILYTNQVESVDRIEKFGVAMKTARTLINMPASQGAIGDIYNFKLAPSLTLGCGSWGGNSISENVGPKHLINVKRIAERRENMLWFRVPDKIYFKFGCLPVALEELNAMKKKRAFIVTDRVLFDLGYTHKITNILSENHIEYKIFSDVEPDPTLKAAKLGADAMRDFNPDVIIAIGGGSPMDAAKIMWVMYEHPDVRFEDLAMRFMDIRKRVYEFPPMGEKAILVAIPTSAGTGSEVTPFAVITDQQTGVKYPLADYALTPNMAIIDAELMMSMPKGLTAASGIDALVHAIEAYVSVLASEYTNGLALEAIRLTFKYLPDAYNGGTTNIKAREKMAHASSVAGMAFANAFLGICHSMAHKLGAFHHVPHGIANALLIDEVIRFNATDAPRKQAAFPQYKYPNAGWRYARIADYLNLGGNTEEEKVELLIKAIDDLKGKVGIPKSIKEFGVSEEKFYASMDEMVEQAFDDQCTGANPRYPLMSEIKEMYIKSYNVSNK

SEQ ID NO: 12 - protein, 869 aa, Clostridium arbusti
MAKVSNIDELNVRLEEIREAQRKFGTYTQEQVDEIFRQAAMAALDARIPLAKMAAEETGMGLVEDKVIKNHFAAEYIYNQYKDEKTCGVVETDKSYGITKIAEPIGIVAAVIPTTNPTSTAIFKTLISLKTRNAIMLSPHPRAKKSTIAAAKIILDAAVKAGAPEGIIGWIDEPSIELTQILMQEADITLATGGPSMVKSAYSSGKPAIGVGPGNTPVIIDESAHIKMAVSSVILSKTFDNGVICASEQSVIVLDSIYDEVRKEFAERGAYIIKESEIDKVRKTIFINGSINSKIVGQSAYKIAEMSGIKVPETARILIGEVTSVGKEEPFAHEKLSTVLAMYRAENFDDALDKAVTLVNLGGLGHTSAIYADIIKAKDKIDKFSNAMKTVRTFINIPAAQGASGDLYNFKIAPSFTLGCGSWGGNSVSENVGPKHLLNIKRVAERRENMLWFRVPEKVYFKFGCLQFALRELKDLNKKRAFIVTDKVLYDLGYADAITKVLEEIGVDFKVFTEVEPDPTLSTARKGTEEMMDFKPDTIISLGGGSAMDAAKIMWVMYEHPEVKFEDLAMRFMDIRKRIYNFPKLGEKAMMIAVATSAGTGSEVTPFAVITDEKTGVKYPLADYELTPNMAIVDAELMMNMPKGLTAASGIDALIHGIEAYTSVLASEYTNGLALEAIRLIFKYLPTAYAEGTTNEKAREKMAHASTMAGMAFANAFLGVCHSMAHKLGAEHHIAHGTANALLIEEVIRFNSADNPVKQAAYPQYKYPNAKWRYGKIADYLNLGGNTDDEKVELLIKAIHELKEKINIPMSIKDAGVSEKNFYATLDKMCELAFDDQCTGANPRYPLISEIKQMLITAFDKTEINTEIK

SEQ ID NO: 13 - protein, 554 aa, Saccharomyces cerevisiae
CCAAAATAGGGGGCGGGTTACACAGAATATATAACATCGTAGGTGTCTGGGTGAACAGTTTATTCCTGGCATCCACTAAATATAATGGAGCCCGCTTTTTAAGCTGGCATCCAGAAAAAAAAAGAATCCCAGCACCAAAATATTGTTTTCTTCACCAACCATCAGTTCATAGGTCCATTCTCTTAGCGCAACTACAGAGAACAGGGGCACAAACAGGCAAAAAACGGGCACAACCTCAATGGAGTGATGCAACCTGCCTGGAGTAAATGATGACACAAGGCAATTGACCCACGCATGTATCTATCTCATTTTCTTACACCTTCTATTACCTTCTGCTCTCTCTGATTTGGAAAAAGCTGAAAAAAAAGGTTGAAACCAGTTCCCTGAAATTATTCCCCTACTTGACTAATAAGTATATAAAGACGGTAGGTATTGATTGTAATTCTGTAAATCTATTTCTTAAACTTCTTAAATTCTACTTTTATAGTTAGTCTTTTTTTTAGTTTTAAAACACCAAGAACTTAGTTTCGAATAAACACACATAAACAAACAAA

SEQ ID NO: 14 - DNA, 550 bp, Saccharomyces cerevisiae
cgctcagcatctgcttcttcccaaagatgaacgcggcgttatgtcactaacgacgtgcaccaacttgcggaaagtggaatcccgttccaaaactggcatccactaattgatacatctacacaccgcacgccttttttctgaagcccactttcgtggactttgccatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataata

SEQ ID NO: 15 - DNA, 419 bp, Saccharomyces cerevisiae
ctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaa

SEQ ID NO: 16 - DNA, 598 bp, Saccharomyces cerevisiae
ggctgataatagcgtataaacaatgcatactttgtacgttcaaaatacaatgcagtagatatatttatgcatattacatataatacatatcacataggaagcaacaggcgcgttggacttttaattttcgaggaccgcgaatccttacatcacacccaatcccccacaagtgatcccccacacaccatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaa

SEQ ID NO: 17 - DNA, 383 bp, Saccharomyces cerevisiae
gtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctacgatacagttctcacatcacatccgaacataaacaacc

SEQ ID NO: 18 - DNA, 700 bp, Saccharomyces cerevisiae
gggtgtacaatatggacttcctcttttctggcaaccaaacccatacatcgggattcctataataccttcgttggtctccctaacatgtaggtggcggaggggagatatacaatagaacagataccagacaagacataatgggctaaacaagactacaccaattacactgcctcattgatggtggtacataacgaactaatactgtagccctagacttgatagccatcatcatatcgaagtttcactaccctttttccatttgccatctattgaagtaataataggcgcatgcaacttcttttctttttttttcttttctctctcccccgttgttgtctcaccatatccgcaatgacaaaaaaatgatggaagacactaaaggaaaaaattaacgacaaagacagcaccaacagatgtcgttgttccagagctgatgaggggtatctcgaagcacacgaaactttttccttccttcattcacgcacactactctctaatgagcaacggtatacggccttccttccagttacttgaatttgaaataaaaaaaagtttgctgtcttgctatcaagtataaatagacctgcaattattaatcttttgtttcctcgtcattgttctcgttccctttcttccttgtttctttttctgcacaatatttcaagctataccaagcatacaatcaactatctcatataca

SEQ ID NO: 19 - DNA, 549 bp, Saccharomyces cerevisiae
gccaaacttttcggttaacacatgcagtgatgcacgcgcgatggtgctaagttacatatatatatatatatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaata

SEQ ID NO: 20 - DNA, 650 bp, Saccharomyces cerevisiae
acgcaagccctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaa

SEQ ID NO: 21 - DNA, 700 bp, Saccharomyces cerevisiae
ttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaa

SEQ ID NO: 22 - DNA, 998 bp, Saccharomyces cerevisiae
aaccagggcaaagcaaaataaaagaaacttaatacgttatgccgtaatgaagggctaccaaaaacgataatctcaactgtaaacaggtacaatgcggacccttttgccacaaaacatacatcattcattgccggaaaaagaaagaagtgaagacagcagtgcagccagccatgttgcgccaatctaattatagatgctggtgccctgaggatgtatctggagccagccatggcatcatgcgctaccgccggatgtaaaatccgacacgcaaaagaaaaccttcgaggttgcgcacttcgcccacccatgaaccacacggttagtccaaaaggggcagttcagattccagatgcgggaattagcttgctgccaccctcacctcactaacgctgcggtgtgcggatacttcatgctatttatagacgcgcgtgtcggaatcagcacgcgcaagaaccaaatgggaaaatcggaatgggtccagaactgctttgagtgctggctattggcgtctgatttccgttttgggaatcctttgccgcgcgcccctctcaaaactccgcacaagtcccagaaagcgggaaagaaataaaacgccaccaaaaaaaaaaataaaagccaatcctcgaagcgtgggtggtaggccctggattatcccgtacaagtatttctcaggagtaaaaaaaccgtttgttttggaattccccatttcgcggccacctacgccgctatctttgcaacaactatctgcgataactcagcaaattttgcatattcgtgttgcagtattgcgataatgggagtcttacttccaacataacggcagaaagaaatgtgagaaaattttgcatcctttgcctccgttcaagtatataaagtcggcatgcttgataatctttctttccatcctacattgttctaattattcttattctcctttattctttcctaacataccaagaaattaatcttctgtcattcgcttaaacactatatcaata

SEQ ID NO: 23 - DNA, 700 bp, Saccharomyces cerevisiae
gtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 24 - DNA, 400 bp, Saccharomyces cerevisiae
agattttggtgttagatggtactcttgcatatgtaacctttaataaattttgcaaatcgaattcctttgtaacgtgcaaagcattttatagcctggcgctcgcattgttaagcaacaggcggtgcggcaacgttgaaatgtttcacgcagggttttttacgtactgcacggcattctggagtgaaaaaaaatgaaaagtacagctcgaagttttttgtccatcggttgtactttgcagagtattagtcatttttgatatcagagtactactatcgaagcatttttacgcttgaataacttgaatattattgaaagcttagttcaaccaagctgaaaagaaccattattcaacataattggaaatcatttcgttactaaatcgtccgaaaattgcagaaaa

SEQ ID NO: 25 - DNA, 505 bp, Saccharomyces cerevisiae
cggcaaacttcaacgatttctatgatgcattttataattagtaagccgatcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttccagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcacataaa

SEQ ID NO: 26 - DNA, 500 bp, Candida glabrata
cacaccacacaaccgtcagcaccccggctgtacgtctgtgaaggctgcggtatagacacggactgcgatacagaactcatgacttatatctgtagactcctctgcttcaatgcgaactccaggatcaccgaatagcatgcgatgagctgttgattcttatatataattatctattgcattttttttttaatgctgcatgggggggcctagtaaatcacccgtacaagtcacgcgtgagagaaagagaagggccctttcgtcgtggaagcgtggatcgtgagcgacctgtttctaaatatagcttttgggtaggatattatattaagtgaaattttattagagggtaaatgtatgtgaaagttatgtataatatgttgctaaattagcgatcgtgaatgcatagaatctaatcgttatagaaaaccgcaacttgtgctgttttgttgtgttttcttgtcgtttttttatattatttatctagtattttgctttagttgtta

SEQ ID NO: 27 - DNA, 425 bp, Saccharomyces bayanus
agaaggaggggtcctattaccaatacttggacgctatacgtgcatatgtacatgtacgtatctgtatttaaacacttttgtattattttctttatatatgtgtataggtttacatggttgacttttatcattgtttgtgcacatttgcaatggccatttttttgtttttgagaaaggtattattgctgtcactattcgagatgcttttgctgacattcctcctagaagccaaaaggccgatgcgttttttccgctgagaggataccagcaaaaaaagctaccagtacaagatgggacggcaaaagcgtataaaagaagaagcaaaatgaccagatatgctttcaatttcatcaatgtttctttctccctgttatgatccagaagaataatcaaaagcaaaacatctattcaatcaatctcataaa

SEQ ID NO: 28 - DNA, 741 bp, Artificial Sequence
  Modified pACU1
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaattcgaaaaagacatttttgctgtcagtcactgtcaagagattcttttgctggcatttcttccagaagcaaaaagagcgatgcgtcttttccgctgaaccgttccagcaaaaaagactaccaacgaattctaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 29 - DNA, 757 bp, Artificial Sequence
  Modified pACU2
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccgaattcgaaaaagacatttttgctgtcagtcactgtcaagagattcttttgctggcatttcttccagaagcaaaaagagcgatgcgtcttttccgctgaaccgttccagcaaaaaagactaccaacgaattccacgtgaagctgtcgatattggggaactgtggtggttggcaaatgactaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 30 - DNA, 498 bp, Artificial Sequence
  Modified pACU3p
ttatattgaattttcaaaaattcttactttttttttggatggacgcaaagaagtttaataatcatattacatggcattaccaccatatacatatccatatctaatcttacttatatgttgtggaaatgtaaagagcccgaattcgaaaaagacatttttgctgtcagtcactgtcaagagattcttttgctggcatttcttccagaagcaaaaagagcgatgcgtcttttccgctgaaccgttccagcaaaaaagactaccaacgaattcggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaaactata

SEQ ID NO: 31 - DNA, 498 bp, Artificial Sequence
  Modified pACU4p
ttatattgaattttcaaaaattcttactttttttttggatggacgcaaagaagtttaataatcatattacatggcattaccaccatatacatatccatatctaatcttacttatatgttgtggaaatgtaaagagcccgaattcgttggtagtcttttttgctggaacggttcagcggaaaagacgcatcgctctttttgcttctggaagaaatgccagcaaaagaatctcttgacagtgactgacagcaaaaatgtctttttcgaattcggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaaactata

SEQ ID NO: 32 - DNA, 530 bp, Artificial Sequence
  Modified pACU5
ggaggacgaaacaaaaaagtgaaaaaaaatgaaaatttttttggaaaaccaagaaatgaattatatttccgtgtgagacgacatcgtcgaatatgattcagggtaacagtattgatgtaatcaatttcctacctgaatctaaaattcccggaattcgaaaaagacatttttgctgtcagtcactgtcaagagattcttttgctggcatttcttccagaagcaaaaagagcgatgcgtcttttccgctgaaccgttccagcaaaaaagactaccaacgaattccgagcagatccgccaggcgtgtatatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggacctttgcagcataaattactatacttctatagacacacaaacacaaatacacacactaaattaata

SEQ ID NO: 33 - DNA, 867 bp, Artificial Sequence
  Modified pACU6
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaattcgaaaaagacatttttgctgtcagtcactgtcaagagattcttttgctggcatttcttccagaagcaaaaagagcgatgcgtcttttccgctgaaccgttccagcaaaaaagactaccaacgaattcgaaaaagacatttttgctgtcagtcactgtcaagagattcttttgctggcatttcttccagaagcaaaaagagcgatgcgtcttttccgctgaaccgttccagcaaaaaagactaccaacgaattctaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 34 - DNA, 867 bp, Artificial Sequence
  Modified pACU7
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaattcgttggtagtcttttttgctggaacggttcagcggaaaagacgcatcgctctttttgcttctggaagaaatgccagcaaaagaatctcttgacagtgactgacagcaaaaatgtctttttcgaattcgttggtagtcttttttgctggaacggttcagcggaaaagacgcatcgctctttttgcttctggaagaaatgccagcaaaagaatctcttgacagtgactgacagcaaaaatgtctttttcgaattctaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 35 - DNA, 1119 bp, Artificial Sequence
  Modified pACU8
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaattcgaaaaagacatttttgctgtcagtcactgtcaagagattcttttgctggcatttcttccagaagcaaaaagagcgatgcgtcttttccgctgaaccgttccagcaaaaaagactaccaacgaattcgaaaaagacatttttgctgtcagtcactgtcaagagattcttttgctggcatttcttccagaagcaaaaagagcgatgcgtcttttccgctgaaccgttccagcaaaaaagactaccaacgaattcgaaaaagacatttttgctgtcagtcactgtcaagagattcttttgctggcatttcttccagaagcaaaaagagcgatgcgtcttttccgctgaaccgttccagcaaaaaagactaccaacgaattcgaaaaagacatttttgctgtcagtcactgtcaagagattcttttgctggcatttcttccagaagcaaaaagagcgatgcgtcttttccgctgaaccgttccagcaaaaaagactaccaacgaattctaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 36 - DNA, 624 bp, Artificial Sequence
  Modified pACU9
tatagttttttctccttgacgttaaagtatagaggtatattaacaattttttgttgatacttttatgacatttgaataagaagtaatacaaactgaaaatgttgaaagtattagttaaagtggttatgcagcttttccatttatatatctgttaatagatcaaaaatcatcgcttcgctgattaattaccccagaaataaggctaaaaaactaatcgcattatcatccgaattcgaaaaagacatttttgctgtcagtcactgtcaagagattcttttgctggcatttcttccagaagcaaaaagagcgatgcgtcttttccgctgaaccgttccagcaaaaaagactaccaacgaattcgaaaaagacatttttgctgtcagtcactgtcaagagattcttttgctggcatttcttccagaagcaaaaagagcgatgcgtcttttccgctgaaccgttccagcaaaaaagactaccaacgaattcgggctctttacatttccacaacatataagtaagattagatatggatatgtatatggtggtaatgccatgtaatatgattattaaacttctttgcgtccatccaaaaaaaaagtaagaatttttgaaaattcaatataa

SEQ ID NO: 37 - DNA, 876 bp, Artificial Sequence
  Modified pACU10p
ttatattgaattttcaaaaattcttactttttttttggatggacgcaaagaagtttaataatcatattacatggcattaccaccatatacatatccatatctaatcttacttatatgttgtggaaatgtaaagagcccgaattggttggtagtcttttttgctggaacggttcagcggaaaagacgcatcgctctttttgcttctggaagaaatgccagcaaaagaatctcttgacagtgactgacagcaaaaatgtctttttcgaattcgttggtagtcttttttgctggaacggttcagcggaaaagacgcatcgctctttttgcttctggaagaaatgccagcaaaagaatctcttgacagtgactgacagcaaaaatgtctttttcgaattcgttggtagtcttttttgctggaacggttcagcggaaaagacgcatcgctctttttgcttctggaagaaatgccagcaaaagaatctcttgacagtgactgacagcaaaaatgtctttttcgaattcgttggtagtcttttttgctggaacggttcagcggaaaagacgcatcgctctttttgcttctggaagaaatgccagcaaaagaatctcttgacagtgactgacagcaaaaatgtctttttccaattcggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaaactata

SEQ ID NO: 38 - DNA, 633 bp, Artificial Sequence
  Modified pACU11
gctcagcatctgcttcttcccaaagatgaacgcggcgttatgtcactaacgacgtgcaccaacttgcgggaattcgaaaaagacatttttgctgtcagtcactgtcaagagattcttttgctggcatttcttccagaagcaaaaagagcgatgcgtcttttccgctgaaccgttccagcaaaaaagactaccaacgaattccaccgcacgccttttttctgaagcccactttcgtggactttgccatatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataata

SEQ ID NO: 39 - DNA, 1119 bp, Artificial Sequence
  Modified pACU12
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaattggttggtagtcttttttgctggaacggttcagcggaaaagacgcatcgctctttttgcttctggaagaaatgccagcaaaagaatctcttgacagtgactgacagcaaaaatgtctttttcgaattcgttggtagtcttttttgctggaacggttcagcggaaaagacgcatcgctctttttgcttctggaagaaatgccagcaaaagaatctcttgacagtgactgacagcaaaaatgtctttttcgaattcgttggtagtcttttttgctggaacggttcagcggaaaagacgcatcgctctttttgcttctggaagaaatgccagcaaaagaatctcttgacagtgactgacagcaaaaatgtctttttcgaattcgttggtagtcttttttgctggaacggttcagcggaaaagacgcatcgctctttttgcttctggaagaaatgccagcaaaagaatctcttgacagtgactgacagcaaaaatgtctttttccaattctaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 40 - DNA, 1497 bp, Artificial Sequence
  Modified pACU13
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaattggttggtagtcttttttgctggaacggttcagcggaaaagacgcatcgctctttttgcttctggaagaaatgccagcaaaagaatctcttgacagtgactgacagcaaaaatgtctttttcgaattcgttggtagtcttttttgctggaacggttcagcggaaaagacgcatcgctctttttgcttctggaagaaatgccagcaaaagaatctcttgacagtgactgacagcaaaaatgtctttttcgaattcgttggtagtcttttttgctggaacggttcagcggaaaagacgcatcgctctttttgcttctggaagaaatgccagcaaaagaatctcttgacagtgactgacagcaaaaatgtctttttcgaattcgttggtagtcttttttgctggaacggttcagcggaaaagacgcatcgctctttttgcttctggaagaaatgccagcaaaagaatctcttgacagtgactgacagcaaaaatgtctttttcgaattcgttggtagtcttttttgctggaacggttcagcggaaaagacgcatcgctctttttgcttctggaagaaatgccagcaaaagaatctcttgacagtgactgacagcaaaaatgtctttttcgaattcgttggtagtcttttttgctggaacggttcagcggaaaagacgcatcgctctttttgcttctggaagaaatgccagcaaaagaatctcttgacagtgactgacagcaaaaatgtctttttcgaattcgttggtagtcttttttgctggaacggttcagcggaaaagacgcatcgctctttttgcttctggaagaaatgccagcaaaagaatctcttgacagtgactgacagcaaaaatgtctttttccaattctaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 41 - DNA, 1011 bp, Artificial Sequence
  Modified pACU14
gctcagcatctgcttcttcccaaagatgaacgcggcgttatgtcactaacgacgtgcaccaacttgcgggaattggaaaaagacatttttgctgtcagtcactgtcaagagattcttttgctggcatttcttccagaagcaaaaagagcgatgcgtcttttccgctgaaccgttccagcaaaaaagactaccaacgaattcgaaaaagacatttttgctgtcagtcactgtcaagagattcttttgctggcatttcttccagaagcaaaaagagcgatgcgtcttttccgctgaaccgttccagcaaaaaagactaccaacgaattcgaaaaagacatttttgctgtcagtcactgtcaagagattcttttgctggcatttcttccagaagcaaaaagagcgatgcgtcttttccgctgaaccgttccagcaaaaaagactaccaacgaattcgaaaaagacatttttgctgtcagtcactgtcaagagattcttttgctggcatttcttccagaagcaaaaagagcgatgcgtcttttccgctgaaccgttccagcaaaaaagactaccaaccaattccaccgcacgccttttttctgaagcccactttcgtggactttgccatatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataata

SEQ ID NO: 42 - DNA, 398 bp, Artificial Sequence
  Modified pACU15
tatagttttttctccttgacgttaaagtatagaggtatattaacaattttttgttgatacttttatgacatttgaataagaagtaatacaaactgaaaatgttgaaagtattagttaaagtggttatgcagcttttccatttatatatctgttaatagatcaaaaatcatcgcttcgctgattaattaccccagaaataaggctaaaaaactaatcgcattatcatccgaattcgttggtagtcttttttgctggaacggttcagcggaaaagacgcatcgctctttttgcttctggaagaaatgccagcaaaagaatctcttgacagtgactgacagcaaaaatgtctttttcgaattcgggctctttacatttccacaacatataagtaagattag

SEQ ID NO: 43 - DNA, 428 bp, Artificial Sequence
  Modified pGAL/CUP1p
ttatattgaattttcaaaaattcttactttttttttggatggacgcaaagaagtttaataatcatattacatggcattaccaccatatacatatccatatctaatcttacttatatgttgtggaaatgtaaagagcccgaattcgaaaaagacatttttgctgtcagtcactgtcaagagattcttttgctggcatttcttccagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcacataaa

SEQ ID NO: 44 - DNA, 518 bp, Saccharomyces cerevisiae
gtggacgaaaagacataactgcagaagtacagctgcctttatttcttgtggtcatttattgcttttattttcaagtcagatatacaagaaaatcaaatcccatcgtcaacgtcacgtataaacgattaatttacagtaataccatactctaccaacattattttagtccgacgttcagtcctgtaggtgttccaaatccttctggcattgacttctgtgcagaaacccttcaaaatgagttccactttacgtcagatcgcataacaaccggtcatatatttttttcttttgctaaaccccctactgcaagcacttttaagaaaaagaacaataaatgcgtctttattgctgtgtggaagtgatttttgtctttcggacaaaaaaaggatagggatgcgagagggctgtgaagtagtgatcaagcggggcctatataagaagggcgcacatcgtcccccctaagaatagcgaagcgatattacactgaacactacaatgtcaaatagtactcaataaat

SEQ ID NO: 45 - DNA, 510 bp, Saccharomyces cerevisiae
gatctctgctgacgttgtatccacagatctaattgcaagatagcctcttgcgaccttattaaaagcctctccgtgatatcctctagggcttgggttgccattaatcgatgtgtccttgtttccttatgcgagctgtttcttatctatcttatggtcccattctttactgcactgtttacattttgatcaattgcgaaatgttcctactatttttctttttctcttttcgcgagtactaatcaccgcgaacggaaactaatgagtcctctgcgcggagacatgattccgcatgggcggctcctgttaagccccagcggaaatgtaattccactgagtgtcattaaatagtgccaaagctttatcaaattgtttgcgatgagataagataaaagggacaatatgaggaggaacacaggtatataaatatcgccaaataaaaggaaaatgtttatacagttttctcttttttaagtgctggatagacaagagacaggaaaattaaccagcgag

SEQ ID NO: 46 - DNA, 601 bp, Saccharomyces cerevisiae
caagtccgattgttcctcttcaggagcttcctgaaccaaactttttccgcaaggccgcattttgaaccgtattttgctcgttccagcctttccacgtttttgttatctaagcaacttggcacatttccctactatactacaaaccgatacgtaaatacttccctaaatagcatatgaattattcagtaatttttaaggatcgaaactgcacctcaactattcgttactgtggttatgttctcatgtattgatgcaaatcatgggatatttgctcaagacgacggtaaaatgagcaaaaatggcacgatcctgaaaagagcacttttcaagattcgggctacaaaatgcaacataaaaaatgttgtattgtcatctcgacagggtcttgtatgttttattcctcttatgattagttcacattagtaaaacagatacgcagtgtgctcttaataaacaactactccatagctttatttgcataacaaaacttttaagcacaaacttaaacaggtggagtaatagttcggcggcgactcaaattacatttgttggaagaatcgaatagaaaataaaaaaaagtgtattatatttgacattcaaa

SEQ ID NO: 47 - DNA, 522 bp, Saccharomyces cerevisiae
gatgtgatgacaaaacctcttccgataaaaacatttaaactattaacaaacaaatggattcattagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaacgatgataataatatttatagaattgtgtagaattgcagattcccttttatggattcctaaatcctccaggagaacttctagtatatctacatacctaatattattgccttattaaaaatggaatcccaacaattacatcaaaatccacattctcttcacttctccgatagacttgtaatttatcttatttcatttcctaacactttgatcgaagaagagggataacaacagacgaaaacacatttaagggctatacaaag

SEQ ID NO: 48 - DNA, 675 bp, Saccharomyces cerevisiae
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaattgtcatgggatatttgctcaagacgacggtaaaatgagcaaatatggcacgatcctcaattctaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 49 - DNA, 674 bp, Artificial Sequence
  Modified pCUR2
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgattgaggatcgtgccatatttgctcattttaccgtcgtcttgagcaaatatcccatgacaattctaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 50 - DNA, 794 bp, Artificial Sequence
  Modified pCUR3
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaattaggatcgtgccatatttgctcattttaccgtcgtcttgagcaaatatcccatgacaattgaggatcgtgccatatttgctcattttaccgtcgtcttgagcaaatatcccatgacaattgaggatcgtgccatatttgctcattttaccgtcgtcttgagcaaatatcccatgacaattctaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 51 - DNA, 850 bp, Artificial Sequence
  Modified pCUR4
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaattgtcatgggatatttgctcaagacgacggtaaaatgagcaaatatggcacgatcctcaattgtcatgggatatttgctcaagacgacggtaaaatgagcaaatatggcacgatcctcaatgtcatgggatatttgctcaagacgacggtaaaatgagcaaatatggcacgatcctcaattgtcatgggatatttgctcaagacgacggtaaaatgagcaaatatcccatgacaattctaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 52 - DNA, 491 bp, Artificial Sequence
  Modified pCUR5p
ttatattgaattttcaaaaattcttactttttttttggatggacgcaaagaagtttaataatcatattacatggcattaccaccatatacatatccatatctaatcttacttatatgttgtggaaatgtaaagagcccgaattgtcatgggatatttgctcaagacgacggtaaaatgagcaaatatggcacgatcctcaattgtcatgggatatttgctcaagacgacggtaaaatgagcaaatatggcacgatcccaattcggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaaactata

SEQ ID NO: 53 - DNA, 833 bp, Artificial Sequence
  Modified pCUR6
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccgaattgaggatcgtgccatatttgctcattttaccgtcgtcttgagcaaatatcccatgacaattgaggatcgtgccatatttgctcattttaccgtcgtcttgagcaaatatcccatgacaattgaggatcgtgccatatttgctcattttaccgtcgtcttgagcaaatatcccatgacaattcatgatcgcaaaatggcaaatggcacgtgaagctgtcgatattggggaactgtggtggttggcaaatgactaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 54 - DNA, 803 bp, Artificial Sequence
  Modified pCUR7
gtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaattcaggatcgtgccatatttgctcattttaccgtcgtcttgagcaaatatcccatgacaattgaggatcgtgccatatttgctcattttaccgtcgtcttgagcaaatatcccatgagaattcttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 55 - DNA, 863 bp, Artificial Sequence
  Modified pCUR8
gtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaattcaggatcgtgccatatttgctcattttaccgtcgtcttgagcaaatatcccatgacaattgaggatcgtgccatatttgctcattttaccgtcgtcttgagcaaatatcccatgacaattgaggatcgtgccatatttgctcattttaccgtcgtcttgagcaaatatcccatgagaattcttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 56 - DNA, 863 bp, Artificial Sequence
  Modified pCUR9
gtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaattctcatgggatatttgctcaagacgacggtaaaatgagcaaatatggcacgatcctcaattgtcatgggatatttgctcaagacgacggtaaaatgagcaaatatggcacgatcctcaattgtcatgggatatttgctcaagacgacggtaaaatgagcaaatatggcacgatcctgaattcttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 57 - DNA, 923 bp, Artificial Sequence
  Modified pCUR10
gtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaattctcatgggatatttgctcaagacgacggtaaaatgagcaaatatggcacgatcctcaattgtcatgggatatttgctcaagacgacggtaaaatgagcaaatatggcacgatcctcaattgtcatgggatatttgctcaagacgacggtaaaatgagcaaatatggcacgatcctcaattgtcatgggatatttgctcaagacgacggtaaaatgagcaaatatggcacgatcctgaattcttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 58 - DNA, 983 bp, Artificial Sequence
  Modified pCUR11
gtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaattctcatgggatatttgctcaagacgacggtaaaatgagcaaatatggcacgatcctcaattgtcatgggatatttgctcaagacgacggtaaaatgagcaaatatggcacgatcctcaattgtcatgggatatttgctcaagacgacggtaaaatgagcaaatatggcacgatcctcaattgtcatgggatatttgctcaagacgacggtaaaatgagcaaatatggcacgatcctcaattgtcatgggatatttgctcaagacgacggtaaaatgagcaaatatggcacgatcctgaattcttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 59 - DNA, 1043 bp, Artificial Sequence
  Modified pCUR12
gtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaattcaggatcgtgccatatttgctcattttaccgtcgtcttgagcaaatatcccatgacaattgaggatcgtgccatatttgctcattttaccgtcgtcttgagcaaatatcccatgacaattgaggatcgtgccatatttgctcattttaccgtcgtcttgagcaaatatcccatgagaattcaggatcgtgccatatttgctcattttaccgtcgtcttgagcaaatatcccatgacaattgaggatcgtgccatatttgctcattttaccgtcgtcttgagcaaatatcccatgacaattgaggatcgtgccatatttgctcattttaccgtcgtcttgagcaaatatcccatgagaattcttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 60 - DNA, 1043 bp, Artificial Sequence
  Modified pCUR13
gtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaattctcatgggatatttgctcaagacgacggtaaaatgagcaaatatggcacgatcctcaattgtcatgggatatttgctcaagacgacggtaaaatgagcaaatatggcacgatcctcaattgtcatgggatatttgctcaagacgacggtaaaatgagcaaatatggcacgatcctgaattctcatgggatatttgctcaagacgacggtaaaatgagcaaatatggcacgatcctcaattgtcatgggatatttgctcaagacgacggtaaaatgagcaaatatggcacgatcctcaattgtcatgggatatttgctcaagacgacggtaaaatgagcaaatatggcacgatcctgaattcttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 61 - DNA, 1223 bp, Artificial Sequence
  Modified pCUR14
gtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaattctcatgggatatttgctcaagacgacggtaaaatgagcaaatatggcacgatcctcaattgtcatgggatatttgctcaagacgacggtaaaatgagcaaatatggcacgatcctcaattgtcatgggatatttgctcaagacgacggtaaaatgagcaaatatggcacgatcctgaattctcatgggatatttgctcaagacgacggtaaaatgagcaaatatggcacgatcctcaattgtcatgggatatttgctcaagacgacggtaaaatgagcaaatatggcacgatcctcaattgtcatgggatatttgctcaagacgacggtaaaatgagcaaatatggcacgatcctgaattctcatgggatatttgctcaagacgacggtaaaatgagcaaatatggcacgatcctcaattgtcatgggatatttgctcaagacgacggtaaaatgagcaaatatggcacgatcctcaattgtcatgggatatttgctcaagacgacggtaaaatgagcaaatatggcacgatcctgaattcttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 62 - DNA, 1283 bp, Artificial Sequence
  Modified pCUR15
gtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaattcaggatcgtgccatatttgctcattttaccgtcgtcttgagcaaatatcccatgacaattgaggatcgtgccatatttgctcattttaccgtcgtcttgagcaaatatcccatgacaattgaggatcgtgccatatttgctcattttaccgtcgtcttgagcaaatatcccatgacaattgaggatcgtgccatatttgctcattttaccgtcgtcttgagcaaatatcccatgagaattcaggatcgtgccatatttgctcattttaccgtcgtcttgagcaaatatcccatgacaattgaggatcgtgccatatttgctcattttaccgtcgtcttgagcaaatatcccatgacaattgaggatcgtgccatatttgctcattttaccgtcgtcttgagcaaatatcccatgagaattcaggatcgtgccatatttgctcattttaccgtcgtcttgagcaaatatcccatgacaattgaggatcgtgccatatttgctcattttaccgtcgtcttgagcaaatatcccatgacaattgaggatcgtgccatatttgctcattttaccgtcgtcttgagcaaatatcccatgagaattcttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 63 - DNA, 686 bp, Artificial Sequence
  Modified pCUR16
gctcagcatctgcttcttcccaaagatgaacgcggcgttatgtcactaacgacgtgcaccaacttgcgggaattctcatgggatatttgctcaagacgacggtaaaatgagcaaatatggcacgatcctcaattgtcatgggatatttgctcaagacgacggtaaaatgagcaaatatggcacgatcctcaatgtcatgggatatttgctcaagacgacggtaaaatgagcaaatatggcacgatcctgaattccaccgcacgccttttttctgaagcccactttcgtggactttgccatatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataata

SEQ ID NO: 64 - DNA, 747 bp, Artificial Sequence
  Modified pCUR17
gctcagcatctgcttcttcccaaagatgaacgcggcgttatgtcactaacgacgtgcaccaacttgcgggaattctcatgggatatttgctcaagacgacggtaaaatgagcaaatatggcacgatcctcaattgtcatgggatatttgctcaagacgacggtaaaatgagcaaatatggcacgatcctcaattctcatgggatatttgctcaagacgacggtaaaatgagcaaatatggcacgatcctcaattctcatgggatatttgctcaagacgacggtaaaatgagcaaatatggcacgatcctgaattccaccgcacgccttttttctgaagcccactttcgtggactttgccatatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataata

SEQ ID NO: 65 - DNA, 500 bp, Saccharomyces cerevisiae
gcaagttaacattagggagaacgtggggccttcctccatgagtgcagagcaattgaagatgtttagaggtttaaaggagaataaccagttgctggatagctctgtgccagctacagtttatgccaaattggcccttcatggtattcctgacggtgttaatggacagtacttgagctataatgaccctgccttggcggactttatgccttgaggatagcaggtacatataaattgttacatactaagtcgatgagtcaaaaaagactcttatacatttatacattttgcattattattttttttttccagcggaatttggaattccgctctcaaccgccaaaattcccctgcgatttcagcgacaaagagtcataaagtcatcctcgagaaaccacgatgaaatatataaaaagcccatcttccctgacggaaactggtattttaggaggcataccataagataacaacgaaaacgctttatttttcacacaaccgcaaaa

SEQ ID NO: 66 - DNA, 650 bp, Saccharomyces cerevisiae
ttgaaaaatgcgaagttgaagtgccatagaagagaaacagcccacacaggggagaagcccactggaaagggggcactgaccaactttaaataggaaacagaagataccacaagccagcgatacaacagcaccaaacaccgaaaagaatagccaaagctgtcctctggtgttggaaaaactggaaaaaacgcaactgcgttggctgctacggtgaaaaattttcctatgacttttttcactgcttgttcgtgcgaaattaccgcaaacccggtaaaatgtacacgtatcaagtgataaacaatttcgtgtcaagtgagcagaatggagcgatttggaaaaaaaaaatttttattgttttttcccccgggattttgctcgagatgactgaaattttgtaatcgatgagtctataccagaggcagcaaatatcaccaacatacacaggtatacacaatctcatgtccacacacacgtacagacacgcacatatatatatatatatatatatccccataggtatttatatatacaaaagaatcctcgtgtgtttgtgtgtgcaatagctagttttgcgctgcctcttatagtagacaatatcactttttcaataaaatagaacttgcaaggaaacaaaattgtatcgcttcaag

SEQ ID NO: 67 - DNA, 500 bp, Saccharomyces cerevisiae
acatatgcaagagtcttatgtatcgtatctaagtgccacgtaggggattcccatcatttgatgatttccaaatataatacctgtagagagcggtggagcaaaagtcaaattttaatcgcaactgcagacaagtcaagctgaggaaattgtggatgatctcttgtttcttttgatattcaccacaacagaagtgaagagtgtgattgcggttactactgaccacgaagcaatgcgtttagtagtgaaaagaattactcatactctggaatcgaaattccgttggaaaaattcgctttgtagtgaaaaataaagatgtcaataaagggtattgagaatttccaatggaattatcagcaatagatgatagaaagtagcacagaatttggcttaatggtatataaaccgtagggtcctggtaaaattacatgggaaggatccttaggcagtagggaaaacttatcaggacaattgagttatattaacgtattatatattttaat

SEQ ID NO: 68 - DNA, 494 bp, Artificial Sequence
  Modified pLYR1p
ttatattgaattttcaaaaattcttactttttttttggatggacgcaaagaagtttaataatcatattacatggcattaccaccatatacatatccatatctaatcttacttatatgttgtggaaatgtaaagagcccgaattcctcatactctggaatcgaaattccgttggaaaaattcgctttgtagtgaaaaataaagatgtcaataaagggtattgagaatttccaatggaattatcagcaatagatgatagaaagaattcggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaaactata

SEQ ID NO: 69 - DNA, 494 bp, Artificial Sequence
  Modified pLYR2p
ttatattgaattttcaaaaattcttactttttttttggatggacgcaaagaagtttaataatcatattacatggcattaccaccatatacatatccatatctaatcttacttatatgttgtggaaatgtaaagagcccgaattctttctatcatctattgctgataattccattggaaattctcaataccctttattgacatctttatttttcactacaaagcgaatttttccaacggaatttcgattccagagtatgaggaattcggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaaactata

SEQ ID NO: 70 - DNA, 616 bp, Artificial Sequence
  Modified pLYR3p
ttatattgaattttcaaaaattcttactttttttttggatggacgcaaagaagtttaataatcatattacatggcattaccaccatatacatatccatatctaatcttacttatatgttgtggaaatgtaaagagcccgaattcctcatactctggaatcgaaattccgttggaaaaattcgctttgtagtgaaaaataaagatgtcaataaagggtattgagaatttccaatggaattatcagcaatagatgatagaaagaattcctcatactctggaatcgaaattccgttggaaaaattcgctttgtagtgaaaaataaagatgtcaataaagggtattgagaatttccaatggaattatcagcaatagatgatagaaagaattcggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaaactata

SEQ ID NO: 71 - DNA, 616 bp, Artificial Sequence
  Modified pLYR4p
ttatattgaattttcaaaaattcttactttttttttggatggacgcaaagaagtttaataatcatattacatggcattaccaccatatacatatccatatctaatcttacttatatgttgtggaaatgtaaagagcccgaattctttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgaggaattcggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaaactata

SEQ ID NO: 72 - DNA, 738 bp, Artificial Sequence
  Modified pLYR5p
ttatattgaattttcaaaaattcttactttttttttggatggacgcaaagaagtttaataatcatattacatggcattaccaccatatacatatccatatctaatcttacttatatgttgtggaaatgtaaagagcccgaattctttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgaggaattcggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaaactata

SEQ ID NO: 73 - DNA, 1104 bp, Artificial Sequence
  Modified pLYR6p
ttatattgaattttcaaaaattcttactttttttttggatggacgcaaagaagtttaataatcatattacatggcattaccaccatatacatatccatatctaatcttacttatatgttgtggaaatgtaaagagcccgaattgctcatactctggaatcgaaattccgttggaaaaattcgctttgtagtgaaaaataaagatgtcaataaagggtattgagaatttccaatggaattatcagcaatagatgatagaaagaattcctcatactctggaatcgaaattccgttggaaaaattcgctttgtagtgaaaaataaagatgtcaataaagggtattgagaatttccaatggaattatcagcaatagatgatagaaagaattcctcatactctggaatcgaaattccgttggaaaaattcgctttgtagtgaaaaataaagatgtcaataaagggtattgagaatttccaatggaattatcagcaatagatgatagaaacaattgctcatactctggaatcgaaattccgttggaaaaattcgctttgtagtgaaaaataaagatgtcaataaagggtattgagaatttccaatggaattatcagcaatagatgatagaaagaattcctcatactctggaatcgaaattccgttggaaaaattcgctttgtagtgaaaaataaagatgtcaataaagggtattgagaatttccaatggaattatcagcaatagatgatagaaagaattcctcatactctggaatcgaaattccgttggaaaaattcgctttgtagtgaaaaataaagatgtcaataaagggtattgagaatttccaatggaattatcagcaatagatgatagaaacaattcggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaaactata

SEQ ID NO: 74 - DNA, 1836 bp, Artificial Sequence
  Modified pLYR7p
ttatattgaattttcaaaaattcttactttttttttggatggacgcaaagaagtttaataatcatattacatggcattaccaccatatacatatccatatctaatcttacttatatgttgtggaaatgtaaagagcccgaattgtttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgagcaattgtttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgagcaattgtttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgagcaattgtttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgagcaattcggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaaactata

SEQ ID NO: 75 - DNA, 981 bp, Artificial Sequence
  Modified pLYR8
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaattgctcatactctggaatcgaaattccgttggaaaaattcgctttgtagtgaaaaataaagatgtcaataaagggtattgagaatttccaatggaattatcagcaatagatgatagaaagaattcctcatactctggaatcgaaattccgttggaaaaattcgctttgtagtgaaaaataaagatgtcaataaagggtattgagaatttccaatggaattatcagcaatagatgatagaaagaattcctcatactctggaatcgaaattccgttggaaaaattcgctttgtagtgaaaaataaagatgtcaataaagggtattgagaatttccaatggaattatcagcaatagatgatagaaacaattctaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 76 - DNA, 981 bp, Artificial Sequence
  Modified 76
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaattgtttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgagcaattctaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 77 - DNA, 1225 bp, Artificial Sequence
  Modified pLYR10
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaattgtttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgaggaattctttctatcatctattgctgataattccattggaaattctcaataccctttattgacatctttatttttcactacaaagcgaatttttccaacggaatttcgattccagagtatgagcaattctaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 78 - DNA, 1347 bp, Artificial Sequence
  Modified pLYR11
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaattgctcatactctggaatcgaaattccgttggaaaaattcgctttgtagtgaaaaataaagatgtcaataaagggtattgagaatttccaatggaattatcagcaatagatgatagaaagaattcctcatactctggaatcgaaattccgttggaaaaattcgctttgtagtgaaaaataaagatgtcaataaagggtattgagaatttccaatggaattatcagcaatagatgatagaaagaattcctcatactctggaatcgaaattccgttggaaaaattcgctttgtagtgaaaaataaagatgtcaataaagggtattgagaatttccaatggaattatcagcaatagatgatagaaagaattcctcatactctggaatcgaaattccgttggaaaaattcgctttgtagtgaaaaataaagatgtcaataaagggtattgagaatttccaatggaattatcagcaatagatgatagaaagaattcctcatactctggaatcgaaattccgttggaaaaattcgctttgtagtgaaaaataaagatgtcaataaagggtattgagaatttccaatggaattatcagcaatagatgatagaaagaattcctcatactctggaatcgaaattccgttggaaaaattcgctttgtagtgaaaaataaagatgtcaataaagggtattgagaatttccaatggaattatcagcaatagatgatagaaacaattctaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 79 - DNA, 686 bp, Artificial Sequence
  Modified pMET17
ttacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaggtcacatgatcgcaaaatggcaaatggcacgtgaagctgtcgatattggggaactgtggtggttggcaaatgactaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 80 - DNA, 510 bp, Saccharomyces cerevisiae
ccacaggaaatatttcacgtgacttacaaacagagtcgtacgtcaggaccggagtcaggtgaaaaaatgtgggccggtaaagggaaaaaaccagaaacgggactactatcgaactcgtttagtcgcgaacgtgcaaaaggccaatatttttcgctagagtcatcgcagtcatggcagctctttcgctctatctcccggtcgcaaaactgtggtagtcatagctcgttctgctcaattgagaactgtgaatgtgaatatggaacaaatgcgatagatgcactaatttaagggaagctagctagttttcccaactgcgaaagaaaaaaaggaaagaaaaaaaaattctatataagtgatagatatttccatctttactagcattagtttctcttttacgtattcaatatttttgttaaactcttcctttatcataaaaaagcaagcatctaagagcattgacaacactctaagaaacaaaataccaatataatttcaaagtacatatcaaaa

SEQ ID NO: 81 - DNA, 508 bp, Saccharomyces cerevisiae
cctatgcatgtttagagcaagcgcctttgtgagccctcccggttacgacgccttggcaatgtagcagataactctgcacttctagaatcattccactacgacatttggctcatcaccagctcgcgagaaatgtaaataagccaacaaccaagaatgcgtaacattaaagaatacagttgctttcatttcggcgtgatggtacggcacccacggttccttacattattctcgaaaaatagctgcacgcttttccaggaataaaagaccgtgccactaatttcacgtgatcaatatatttacaagccacctcaaaaaatgtggcaatggagaagaggatgaacgactcaatatgacttcaacttcatgaatttgtcaaaatatctatataagatgcaaaatttctatacaacatcagttgcgtatccgttaatgtcgttcattttctctctttgttcgaacttgacatcaagaaaagttggaattatttctccaagcacactgtacacca

SEQ ID NO: 82 - DNA, 552 bp, Saccharomyces cerevisiae
aacgatatgtacgtagtggtataaggtgagggggtccacagatataacatcgtttaatttagtactaacagagacttttgtcacaactacatataagtgtacaaatatagtacagatatgacacacttgtagcgccaacgcgcatcctacggattgctgacagaaaaaaaggtcacgtgaccagaaaagtcacgtgtaattttgtaactcaccgcattctagcggtccctgtcgtgcacactgcactcaacaccataaaccttagcaacctccaaaggaaatcaccgtataacaaagccacagttttacaacttagtctcttatgaagttacttaccaatgagaaatagaggctctttctcgacaaatatgaatatggatatatatatatatatatatatatatatatatatatatatgtaaacttggttcttttttagcttgtgatctctagcttgggtctctctctgtcgtaacagttgtgatatcgtttcttaacaattgaaaaggaactaagaaagtataataataacaagaataaagtataattaac

SEQ ID NO: 83 - DNA, 363 bp, Saccharomyces cerevisiae
gaaacggacgtaagacggaaatagaatttgaagataaagttatatatcactacacacgaatactttcttttttttttttcacaggaaaactgtggtggcgcccttgcctactagtgcatttcttttttcgggttcttgtctcgacgaaattttagcctcatcgtagtttttcactctggtatcgatgaaaaagggaagagtaaaaagttttccgtttagtacttaatgggattggtttgggacgtatatatcgactggtgttgtctgttattcatcgttgtttttcggttagcttcgaaaaaaaaatagagtaaaaaccaggaatttaccctaaaaacaagaaaaaataagataaacgaaaat

SEQ ID NO: 84 - DNA, 500 bp, Saccharomyces cerevisiae
gagctttgctctattatataagataaaatatgcactaaaagtttgcatttctttacataactaaaactaagacattatgcatagcttacctgatcaaaaagtatgtaaacttgttaacatcttcacatgtgattcatctggtcgtactttcttgcggtgcagtgtaatatttctacccacgtgactataattgagcttgaaaactgtggcgtttttccaccgatgggtccacgccagatattaaccgaagccaaaataccgatgaaatttctgagatagctcttgtaaacgacgtcaaatcttcatatgcaaggagatcttgatttctttttggtagtcatctgtcgtcttgaggcgtataagaaggaggttatatctgtcctttctacaaagtattttcgagaatcttgcttctgccccttttttctttttttaaaaggtttaaaaaacataactgtcttcaatatatccagtatttacgacaatatacaaacataatc

SEQ ID NO: 85 - DNA, 913 bp, Saccharomyces cerevisiae
ccttcgctaaataataaacctgaactgtacttagcgaagccttcatagcacctacgtacacgtatatatagacattttacgtaatggagaaactgaggtttttgttttcactttttttctttctttttcactattgctcgaaccgcctgcgatgagctaagaaaaaaaagtgaaagaaatcatagaaagcaaaaatgagattatatagcccagagccctcttctggcgcctgtcccaaggcggaccaacaacaacacttgcccaaacctaagaaaatcccctcatacttttccgtttgtatctcctactttcttacttcctttttttcttctttatttgcttggtttaccattgaagtccatttttactacagacaatagctagtcattcgctatcttccgtttgtcactttttttcaaatttctcatctatatagcgaagtacggaaaagatgtcacttgccggcatctcggccttccccggccaaatggactcatcatctacgatacggcccctttaatccgcaattactttgcccattcggccgtagccgttctaaagccgccgtgccttgcccccaatactcccctaatgatccgggaagttccggtttttttcctttgtttagtggcattttgtgttgcccaaggttgggaaggtccgatttgactttaaggaactacggaaggtatctaaggtttctaaaaacaatatacacgcgcgtgcgtagatatataaagataaagatttatcgatatgagataaagattgctgcatgattctccttctgattctttttccctgtatatattttctccccttctgtataaatcgtacagtcagaagtagtccagaatatagtgctgcagactattacaaaagttcaatacaatatcataaaagttatagtaac

SEQ ID NO: 86 - DNA, 998 bp, Saccharomyces cerevisiae
aatgtgtttataaattattttttttgctggtagcaaaatcaactcattgtcttccattcagagtctaatcgaacgttatcgcaatgcttgcacacttttaaacaatacgatttagtttaagtggatggacccccacgcttagtgttccacaggtttgtccccactgtttttacattccactgtacatttttgcaatagaaggtcattgtatgctaccttgggcggctaagaatacctgtaaaaatttggagaaattagattcgtaaagaatgactcgcaacgactccaatgatttcttcttttcaccctttgaacggccgatatccgcgcgggatcctgaccccgcaatttactccactagaccggcgtgtttctctttttccttttcctggggttagagcccaagagctaatagccgacaaacggactccaaaaaaaaaaggaggcacaggacaaacgcagcacctgcgtcattcacgctgaagcggcagcaagcattttcgatcagctccaattaaatgaagactattcgccgtaccgttcccagatgggtgcgaaagtcagtgatcgaggaagttattgagcgcgcggcttgaaactatttctccatctcagagccgccaagcctaccattattctccaccaggaagttagtttgtaagcttctgcacaccatccggacgtccataattcttcacttaacggtcttttgcccccccttctactataatgcattagaacgttacctggtcatttggatggagatctaagtaacacttactatctcctatggtactatcctttaccaaaaaaaaaaaaaaaaaaaaaaaaaaaaatcagcaaagtgaagtaccctcttgatgtataaatacattgcacatcattgttgagaaatagttttggaagttgtctagtccttctcccttagatctaaaaggaagaagagtaacagtttcaaaagtttttcctcaaagagattaaatactgctactgaaaat

SEQ ID NO: 87 - DNA, 450 bp, Saccharomyces cerevisiae
ttttgctactcgtcatccgatgagaaaaactgttcccttttgccccaggtttccattcatccgagcgatcacttatctgacttcgtcactttttcatttcatccgaaacaatcaaaactgaagccaatcaccacaaaattaacactcaacgtcatctttcactaccctttacagaagaaaatatccatagtccggactagcatcccagtatgtgactcaatattggtgcaaaagagaaaagcataagtcagtccaaagtccgcccttaaccaggcacatcggaattcacaaaacgtttctttattatataaaggagctgcttcactggcaaaattcttattatttgtcttggcttgctaatttcatcttatcctttttttcttttcacacccaaatacctaacaattgagagaaaactcttagcataacataacaaaaagtcaacgaaaa

SEQ ID NO: 88 - DNA, 598 bp, Saccharomyces cerevisiae
tatcttaactgatagtttgatcaaaggggcaaaacgtaggggcaaacaaacggaaaaatcgtttctcaaattttctgatgccaagaactctaaccagtcttatctaaaaattgccttatgatccgtctctccggttacagcctgtgtaactgattaatcctgcctttctaatcaccattctaatgttttaattaagggattttgtcttcattaacggctttcgctcataaaaatgttatgacgttttgcccgcaggcgggaaaccatccacttcacgagactgatctcctctgccggaacaccgggcatctccaacttataagttggagaaataagagaatttcagattgagagaatgaaaaaaaaaaaaaaaaaaggcagaggagagcatagaaatggggttcactttttggtaaagctatagcatgcctatcacatataaatagagtgccagtagcgacttttttcacactcgaaatactcttactactgctctcttgttgtttttatcacttcttgtttcttcttggtaaatagaatatcaagctacaaaaagcatacaatcaactatcaactattaactatatcgtaatacaca

SEQ ID NO: 89 - DNA, 793 bp, Saccharomyces cerevisiae
tgtctaatgcgaaggtacttttatttttttcagattcaaagcaatattatttagacaattgatactaagtgagcttaaggaggattaaacaactgtggaatccttcacaaggattcaatatttgtttttcctggttattttgccatcattcaactttcctcagacgtaaaattcgtgcttagtgatgtctcaatattcccgcagggtaataaaattcaataactatcactatatacgcaacagtattaccctacattgctatcggctcaatggaaatccccatatcatagcttccattgggccgatgaagttagtcgacggatagaagcggttgtcccctttcccggcgagccggcagtcgggccgaggttcggataaattttgtattgtgttttgattctgtcatgagtattacttatgttctctttaggtaaccccaggttaatcaatcacagtttcataccggctagtattcaaattatgacttttcttctgcagtgtcagccttacgacgattatctatgagctttgaatatagtttgccgtgattcgtatctttaattggataataaaatgcgaaggatcgatgacccttattattatttttctacactggctaccgatttaactcatcttcttgaaagtatataagtaacagtaaaatataccgtacttctgctaatgttatttgtcccttatttttcttttcttgtcttatgctatagtacctaagaataacgactattgttttgaactaaacaaagtagtaaaagcacataaaagaattaagaaa

SEQ ID NO: 90 - DNA, 300 bp, Saccharomyces cerevisiae
atttaactccttaagttactttaatgatttagtttttattattaataattcatgctcatgacatctcatatacacgtttataaaacttaaatagattgaaaatgtattaaagattcctcagggattcgatttttttggaagtttttgtttttttttccttgagatgctgtagtatttgggaacaattatacaatcgaaagatatatgcttacattcgaccgttttagccgtgatcattatcctatagtaacataacctgaagcataactgacactactatcatcaatacttgtcacatga

SEQ ID NO: 91 - DNA, 300 bp, Saccharomyces cerevisiae
acaggccccttttcctttgtcgatatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgcaagcttcgcagtttacactctcatc

SEQ ID NO: 92 - DNA, 300 bp, Saccharomyces cerevisiae
gtgaatttactttaaatcttgcatttaaataaattttctttttatagctttatgacttagtttcaatttatatactattttaatgacattttcgattcattgattgaaagctttgtgttttttcttgatgcgctattgcattgttcttgtctttttcgccacatgtaatatctgtagtagatacctgatacattgtggatgctgagtgaaattttagttaataatggaggcgctcttaataattttggggatattggcttttttttttaaagtttacaaatgaattttttccgccaggat

SEQ ID NO: 93 - DNA, 354 bp, Saccharomyces cerevisiae
actagttctagagcggccgccaccgcggtgggcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgttgtaatcgttcttcca

SEQ ID NO: 94 - DNA, 301 bp, Saccharomyces cerevisiae
gcggatctcttatgtctttacgatttatagttttcattatcaagtatgcctatattagtatatagcatctttagatgacagtgttcgaagtttcacgaataaaagataatattctactttttgctcccaccgcgtttgctagcacgagtgaacaccatccctcgcctgtgagttgtacccattcctctaaactgtagacatggtagcttcagcagtgttcgttatgtacggcatcctccaacaaacagtcggttatagtttgtcctgctcctctgaatcgtctccctcgatatttctcatt

SEQ ID NO: 95 - DNA, 299 bp, Saccharomyces cerevisiae
gattaatataattatataaaaatattatcttcttttctttatatctagtgttatgtaaaataaattgatgactacggaaagcttttttatattgtttctttttcattctgagccacttaaatttcgtgaatgttcttgtaagggacggtagatttacaagtgatacaacaaaaagcaaggcgctttttctaataaaaagaagaaaagcatttaacaattgaacacctctatatcaacgaagaatattactttgtctctaaatccttgtaaaatgtgtacgatctctatatgggttactc

SEQ ID NO: 96 - DNA, 299 bp, Saccharomyces cerevisiae
gtgtgcgtaatgagttgtaaaattatgtataaacctactttctctcacaagtactatacttttataaaacgaactttattgaaatgaatatcctttttttcccttgttacatgtcgtgactcgtactttgaacctaaattgttctaacatcaaagaacagtgttaattcgcagtcgagaagaaaaatatggtgaacaagactcatctacttcatgagactactttacgcctcctataaagctgtcacactggataaatttattgtaggaccaagttacaaaagaggatgatggaggttt

SEQ ID NO: 97 - DNA, 305 bp, Saccharomyces cerevisiae
ggatcctaaagtgcttttaactaagaattattagtcttttctgcttattttttcatcatagtttagaacactttatattaacgaatagtttatgaatctatttaggtttaaaaattgatacagttttataagttactttttcaaagactcgtgctgtctattgcataatgcactggaaggggaaaaaaaaggtgcacacgcgtggctttttcttgaatttgcagtttgaaaaataactacatggatgataagaaaacatggagtacagtcactttgagaaccttcaatcagctggtaacgtcttc

SEQ ID NO: 98 - DNA, 300 bp, Saccharomyces cerevisiae
tcgtcataaaatgctcccatctcaaaagtagggcaaaattcatgatcgaccgcgcaaaataaatagatttgcaaataagttttgtatgtacatttattaatatatataatatatcaaaagaaaaaaatcaaaaaaaaaaaaaaaaaaaaattgcactcttattcagtcatcaattacaaaacctagagatagcgatggtgcatattcaataaaaaactccttatactgtcgagaaagcttattattggtacttctcgaagatactaaaaaaggttaatttttggagacggaggcaatagc

SEQ ID NO: 99 - DNA, 301 bp, Saccharomyces cerevisiae
attgaattgaattgaaatcgatagatcaatttttttcttttctctttccccatcctttacgctaaaataatagtttattttattttttgaatattttttatttatatacgtatatatagactattatttatcttttaatgattattaagatttttattaaaaaaaaattcgctcctcttttaatgcctttatgcagtttttttttcccattcgatatttctatgttcgggttcagcgtattttaagtttaataactcgaaaattctgcgttcgttaaagctttcgagaaggatattattta

SEQ ID NO: 100 - DNA, 300 bp, Saccharomyces cerevisiae
taaagtaagagcgctacattggtctacctttttgttcttttacttaaacattagttagttcgttttctttttctcatttttttatgtttcccccccaaagttctgattttataatattttatttcacacaattccatttaacagagggggaatagattctttagcttagaaaattagtgatcaatatatatttgcctttcttttcatcttttcagtgatattaatggtttcgagacactgcaatggccctagttgtctaagaggatagatgttactgtcaaagatgatattttgaatttc

SEQ ID NO: 101 - DNA, 300 bp, Saccharomyces cerevisiae
gaagttttgttagaaaataaatcattttttaattgagcattcttattcctattttatttaaatagttttatgtattgttagctacatacaacagtttaaatcaaattttctttttcccaagtccaaaatggaggtttattttgatgacccgcatgcgattatgttttgaaagtataagactacatacatgtacatatatttaaacatgtaaacccgtccattatattgcttactttcttcttttttgccgttttgacttggacctctggtttgctatttccttacaatctttgctacaat

SEQ ID NO: 102 - DNA, 300 bp, Saccharomyces cerevisiae
gcggattgagagcaaatcgttaagttcaggtcaagtaaaaattgatttcgaaaactaatttctcttatacaatcctttgattggaccgtcatcctttcgaatataagattttgttaagaatattttagacagagatctactttatatttaatatctagatattacataatttcctctctaataaaatatcattaataaaataaaaatgaagcgatttgattttgtgttgtcaacttagtttgccgctatgcctcttgggtaatgctattattgaatcgaagggctttattatattaccct

SEQ ID NO: 103 - DNA, 300 bp, Saccharomyces cerevisiae
gctggttgatggaaaatataattttattgggcaaacttttgtttatctgatgtgttttatactattatctttttaattaatgattctatatacaaacctgtatattttttctttaaccaatttttttttttatagacctagagctgtacttttattctgctatcaagcaaacccctaccccctcttctcaatcctcccctcaggcagaacttatctacctgtatcaaggagcggacgagggagtcctaattgttctacgtataccaatgctagcagcttacataggtggtggcactacca

SEQ ID NO: 104 - DNA, 300 bp, Saccharomyces cerevisiae
tcgaatttacgtagcccaatctaccacttttttttttcattttttaaagtgttatacttagttatgctctaggataatgaactacttttttttttttttttttactgttatcataaatatatataccttattgttgtttgcaaccgtcggttaattccttatcaaggttccccaagttcggatcattaccatcaatttccaacattttcatgagttcttcttcttcattaccgtgttttagggggctgttcgcacttctaatagggctatcaccaagctgttctaattcgtccaaaagtt

SEQ ID NO: 105 - protein, 1219 aa, Chloroflexus aurantiacus (strain ATCC 29366 / DSM 635 / J-10-fl)
MSGTGRLAGKIALITGGAGNIGSELTRRFLAEGATVIISGRNRAKLTALAERMQAEAGVPAKRIDLEVMDGSDPVAVRAGIEAIVARHGQIDILVNNAGSAGAQRRLAEIPLTEAELGPGAEETLHASIANLLGMGWHLMRIAAPHMPVGSAVINVSTIFSRAEYYGRIPYVTPKAALNALSQLAARELGARGIRVNTIFPGPIESDRIRTVFQRMDQLKGRPEGDTAHHFLNTMRLCRANDQGALERRFPSVGDVADAAVFLASAESAALSGETIEVTHGMELPACSETSLLARTDLRTIDASGRTTLICAGDQIEEVMALTGMLRTCGSEVIIGFRSAAALAQFEQAVNESRRLAGADFTPPIALPLDPRDPATIDAVFDWAGENTGGIHAAVILPATSHEPAPCVIEVDDERVLNFLADEITGTIVIASRLARYWQSQRLTPGARARGPRVIFLSNGADQNGNVYGRIQSAAIGQLIRVWRHEAELDYQRASAAGDHVLPPVWANQIVRFANRSLEGLEFACAWTAQLLHSQRHINEITLNIPANISATTGARSASVGWAESLIGLHLGKVALITGGSAGIGGQIGRLLALSGARVMLAARDRHKLEQMQAMIQSELAEVGYTDVEDRVHIAPGCDVSSEAQLADLVERTLSAFGTVDYLINNAGIAGVEEMVIDMPVEGWRHTLFANLISNYSLMRKLAPLMKKQGSGYILNVSSYFGGEKDAAIPYPNRADYAVSKAGQRAMAEVFARFLGPEIQINAIAPGPVEGDRLRGTGERPGLFARRARLILENKRLNELHAALIAAARTDERSMHELVELLLPNDVAALEQNPAAPTALRELARRFRSEGDPAASSSSALLNRSIAAKLLARLHNGGYVLPADIFANLPNPPDPFFTRAQIDREARKVRDGIMGMLYLQRMPTEFDVAMATVYYLADRNVSGETFHPSGGLRYERTPTGGELFGLPSPERLAELVGSTVYLIGEHLTEHLNLLARAYLERYGARQVVMIVETETGAETMRRLLHDHVEAGRLMTIVAGDQIEAAIDQAITRYGRPGPVVCTPFRPLPTVPLVGRKDSDWSTVLSEAEFAELCEHQLTHHFRVARKIALSDGASLALVTPETTATSTTEQFALANFIKTTLHAFTATIGVESERTAQRILINQVDLTRRARAEEPRDPHERQQELERFIEAVLLVTAPLPPEADTRYAGRIHRGRAITV

SEQ ID NO: 106 - protein, 297 aa, Arthrobacter enclensis
MTDQYTFRNPVTAYEHISPPEQHQPEPGLDAALTPKADLGEDTYRGTGRLDGRRAVVTGADSGIGAATAIAFAREGADVVLSYLPEEEEDAARIAGIIEAAGRKAVKVPGDLKDPASCREVVDTAVAVLGGIDILVNNAGKQVAQKDIADITDEQFDHTLKTNVYAMFWLTKAALPHMPAGSAIINTTSIQAYNPSPTLVDYATTKASINNFTKGLAQQLAPRGIRVNAVAPGPIWTPLQVSSGQPKEELPEFGQSTPLGRAGQPAELAPAYVFLASAESSYVVGETLNVNGGSPTP

SEQ ID NO: 107 - protein, 292 aa, Bacillus cereus (strain ATCC 14579 / DSM 31 / JCM 2152 / NBRC 15305 / NCIMB 9373 / NRRL B-3711)
MEHKTLSIGFIGIGVMGKSMVYHLMQDGHKVYVYNRTKAKTDSLVQDGANWCNTPKELVKQVDIVMTMVGYPHDVEEVYFGIEGIIEHAKEGTIAIDFTTSTPTLAKRINEVAKRKNIYTLDAPVSGGDVGAKEAKLAIMVGGEKEIYDRCLPLLEKLGTNIQLQGPAGSGQHTKMCNQIAIASNMIGVCEAVAYAKKAGLNPDKVLESISTGAAGSWSLSNLAPRMLKGDFEPGFYVKHFMKDMKIALEEAERLQLPVPGLSLAKELYEELIKDGEENSGTQVLYKKYIRG

SEQ ID NO: 108 - protein, 248 aa, Escherichia coli (strain K12); identical to SEQ ID NO: 7

SEQ ID NO: 109 - protein, 267 aa, Saccharomyces cerevisiae (strain ATCC 204508 / S288c)
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 110 - protein, 354 aa, Candida albicans (strain SC5314 / ATCC MYA-2876)
MLRTSIRAFSTQPRLSTNYGFIGLGLMGQHMARHVYNQLEPSDKLYVYDVDPKHTTQFLTEVTSQTPQNAPLLTPLNSLKDFTTEVDSQLDFIVTMVPEGKHVKSVVSELVGHYKSTGNYDPSIKTTFLDSSTIDIPTSRDVHQLVKSSIPEFDFIDTPVSGGVAGARKGTLSFMLSRETHDDIDPSLTALLSKMGINIFPCGATHGTGLAAKLANNYLLAITNIAAADSFQLAESFGLNLQNYAKLVAVSTGKSWASVDNCPIPGVYPDNNLPSDVNYEGGFITKLTRKDVVLATESAKFNNRFLMLGDIGRHWYDKACEREDIANRDLSVLFEWLGDLKQNEKGDVIDVKRK

SEQ ID NO: 111 - protein, 497 aa, Pseudomonas aeruginosa (strain ATCC 15692 / DSM 22644 / CIP 104116 / JCM 14847 / LMG 12228 / 1C / PRS 101 / PA O1)
MGTLHHLINGEMVADNGRSADVFNPSTGEAIHKVPLADGKTLQKAIDAARAAFPAWRNTPPAKRAQVLYRFKQLLEQNEARISKLISEEHGKTLEDAAGELKRGIENVEYACAAPEILKGEYSRNVGPNIDAWSDFQPIGVVAGITPFNFPAMVPLWMYPLAIACGNTFILKPSERDPSSTLLIAELFHEAGLPKGVLNVVHGDKEAVDGLLQAPEVKAISFVGSTPIAEYIYAEGTKRGKRVQALGGAKNHAVLMPDADLDNAVSALMGAAYGSCGERCMAISVAVCVGDQVADALIAKLVPQIKALKIGAGTSCGLDMGPLVTAAAQAKVTGYIDSGVAQGAELVVDGRGYQVAGHENGFFLGGSLFDRVTPEMTIYKEEIFGPVLCVVRVNSLEEAMQLINDHEYGNGTCIFTRDGEAARLFCDEIEVGMVGVNVPLPVPVAYHSFGGWKRSLFGDLHAYGPDGVRFYTRRKAITQRWPQRASHEASQFAFPSL

SEQ ID NO: 112 - protein, 541 aa, Candida albicans (strain SC5314 / ATCC MYA-2876)
MTNIAASKLATRNKSIISLSSTTTEYPKGHTTANDEPYLTPSFVNNEFIKSESDTWFDIHDPATNNVVSKVPQSTPEELEDAIASAHKAFPKWRDTSIIKRQGIAFKFVQLLRENMDRIASVIVLEQGKTFADAQGDVLRGLQVAEAACNVTNDLKGESLEVATDMETKMIREPLGVIGSICPFNFPAMVPLWSLPLVLVTGNTAVVKPSERVPGAAMIICELAAKAGVPAGVLNIVHGKHDTVNKLIDDPRIKALTFVGGDKAGKYIYERGSQLGKRVQANLGAKNHLVVLPDANKQSFVNAVNGAAFGAAGQRCMAISVLVTVGKTTKEWVKDVVADAKLLKTGSGFDPKSDLGPVINPESLTRAEEIIEDSVQNGAVLELDGRGYKPTNDPEQKFTKGNFLAPTILTNVKPGMRAYDEEIFAPVLAVVNVDTIDEAIELINSNKYGNGVSLFTNSGGSAQYFTKRIDVGQVGINVPIPVPLPMFSFTGSRGSFLGDLNFYGKAGITFLTKPKTITSAWKLNSVDEEILKPSTSMPIQQ

SEQ ID NO: 113 - protein, 488 aa, Listeria monocytogenes serovar 1/2a (strain ATCC BAA-679 / EGD-e)
MADVRKLKNYIDGEWVESKTDKYEDVINPATGEVLCQVPISTRAELDQAAVIAEQAFEKWSQVAVPRRARVLFGFQQLLIQHKEELARLITLENGKNLSEARGEVQRGIENVEFAAGAPTLMMGDSLASIATDVEAANYRYPVGVVGGIAPFNFPMMVPCWMFPMAIALGNSFILKPSERTPLLMEKLVELFSEAGLPKGVFNVVYGAHDVVNGILENEIIKAVSFVGSKPVGEYVYKTGSANLKRVQALTGAKNHTIVLNDADLEDTVTNVISAAFGSAGERCMACAVVTVEEGIADEFLEALRTAAQNVKIGNGLDDGVFLGPVIREENQKRTIAYIEKGIEEGAKLTVDGRETGLSEGHFVGPTILEDVTTDMTIWKDEIFAPVLSVIRVKNLQEAVRVANQSEFANGACIFTNNAKAIRYFREKIDAGMLGVNLGVPAPMAFFPFSGWKSSFYGTLHANGKDSVDFYTHKKVVTARYSLKGYEE

SEQ ID NO: 114 - protein, 487 aa, Bacillus subtilis subsp. natto
MAEIRKLKNYINGEWVESKTDQYEDVVNPATKEVLCQVPISTKEDIDYAAQTAAEAFETWSKVAVPRRARILFNFQQLLSQHKEELAHLITIENGKNTKEALGEVGRGIENVEFAAGAPSLMMGDSLASIATDVEAANYRYPIGVVGGIAPFNFPMMVPCWMFPMAIALGNTFILKPSERTPLLTEKLVELFEKAGLPKGVFNVVYGAHDVVNGILEHPEIKAISFVGSKPVGEYVYKKGSEHLKRVQSLTGAKNHTIVLNDANLEDTVTNIVGAAFGSAGERCMACAVVTVEEGIADEFMAKLQEKVADIKIGNGLDDGVFLGPVIREDNKKRTLSYIEKGLEEGARLVCDGRENVSDDGYFVGPTIFDNVTTEMTIWKDEIFAPVLSVIRVKNLKEAIEIANKSEFANGACLFTSNSNAIRYFRENIDAGMLGINLGVPAPMAFFPFSGWKSSFFGTLHANGKDSVDFYTRKKVVTARFPAPDFN

SEQ ID NO: 115 - protein, 504 aa, Cupriavidus necator (strain ATCC 43291 / DSM 13513 / N-1)
MTAPYTSPSEVIHYVSGEPYEGNGKRAQAVFNPATGAVARQVRLGTVEDVDAAVASAVAAFPKWADTPPIRRARVMLKFLELMNQHKDELAAIITAEHGKVLSDAAGEVSRGIDIIEFACGVPQLLKGDFTDQVSTGMDNWTLRQPLGVVAGITPFNFPCMVPCWMFPVAIATGNCFILKPSERDPSASLFMARLLKEAGLPDGVFNVIQGDKTVVDALLHHRDVKAVSFVGSTPIANYIYETGARLGKRVQALGGAKNHMVVMPDADIDQALDGLIGAAYGSAGERCMAISVAVLVGDVADKIMPKLEARARELVIKNGMEADAEMGPVVTGQALERIENYIALGVEEGAKLVVDGRNYKVPGHEQGFFTGGTLFDNVTPEMRIYKEEIFGPVLSCVRVDDFAQAVKLINEHEFGNGVACYTRDGQVAREFCRRIEVGMVGINVPIPVPMAWHGFGGWKRSLFGDMHAYGEEGVRFYTRQKSIMQRWPNDTARGAEFAMPTAK

SEQ ID NO: 116 - protein, 486 aa, Bacillus cereus
MITTEIKRVKNHINGEWVESTGTEVEVVPNPATGKIIAYVPLSPKEDVEKAVEAAKAAYEKWSKVPVPNRSRQLYKYLQLLQENKEELAKIITLENGKTLTDATGEVQRGIEAVELATSAPNLMMGQALPNIASGIDGSIWRYPIGVVAGITPFNFPMMIPLWMFPLAIACGNTFVLKTSERTPLLAERLVELFYEAGFPKGVLNLVQGGKDVVNSILENKDIQAVSFVGSEPVARYVYETGTKHGKRVQALAGAKNHAIVMPDCNLEKTVQGVIGSAFASSGERCMACSVVAVVDEIADEFIDVLVAETKKLKVGDGFNEDNYVGPLIRESHKERVLGYINSGVADGATLLVDGRKINEEVGEGYFVGATIFDGVNQEMKIWQDEIFAPVLSIVRVKDLEEGIKLTNQSKFANGAVIYTSNGKHAQTFRDNIDAGMIGVNVNVPAPMAFFAFAGNKASFFGDLGTNGTDGVQFYTRKKVVTERWF

SEQ ID NO: 117 - protein, 503 aa, Halomonas sp. HTNK1
MTIKRIEHYINGHKTNGVADSHQEVTNPATGQVTGQVALASQADVDSAVAAAQAAFPAWSDTPPIRRARVMFKFLELLNAHKDELAEAITREHGKVFTDAQGEVARGIDIVEFACGIPQLLKGDYTEQVSTGIDNWTTRQPLGVVAGITPFNFPVMVPMWMFPLAIAAGNSFVLKPSPLDPSASLMMADLLKQAGLPDGVFNVVQGDKDSVEALIDHPDVKALSFVGSTPIANLIYERGARSGKRIQALGGAKNHMVVMPDANLDKAVDALIGAAYGSAGERCMAISVAVLVGDVADKIVPRLAERARDLKIKNGLELDAEMGPIVTSQAHQRITGYIEKGVAEGAEMVVDGRDFDSSVTGEGCADGFWMGGTLFDHVTPEMTIYREEIFGPVLACVRVPDVATAIQLINDHEFGNGVSCFTESGSVAREFGRRIQVGMVGINVPIPVPMAWHGFGGWKRSMFGDTHAYGEEGVRFYTKQKSIMQRWSDSIDAGAEFAMPTAK

SEQ ID NO: 118 - protein, 492 aa, Lactobacillus casei
MDTTKQNVKTLKNFINGKWVDAKTETFENVYNPATGDVLARVPHSTSEDVADAVTAAKEAFKIWQKVSIPKRAKILFKYQQLLVEHQEELGRIVTEENGKSLDEAVAEVGRGIENVEFAAGVPTLMMGDSLSSVATDVEATNYRYPIGVVGGITPFNFPMMVPCWMFPMAVATGNTFILKPSEKTPLTSQRLVELFQEAGLPDGVLNIVNGAVDVVNGILDHPDIKAISFVGSERVGEYVYKRGSDHLKRVQALTGAKNHTIVLADADLDAAVKGIISSSFGSAGERCMATSVLVLQDEIADKFMAKFTQAAKDIKIGNGLDKGVFLGPVIRKENQERTLNYIQTGVKEGAKLVLDGSAEAKKHDGYFVGPTIFEDVKTDMTIWHDEMFAPVLSVIRAKDLPQAVAIANTSELANGACLFTDSAASIRYFRENIDAGMLGINLGVPAPIAVFPFSGWKHSFFGTLHANGKDSVDFYTHKKVVTARYDQRRFK

SEQ ID NO: 119 - protein, 1822 aa, Chloroflexus aurantiacus
MIDTAPLAPPRAPRSNPIRDRVDWEAQRAAALADPGAFHGAIARTVIHWYDPQHHCWIRFNESSQRWEGLDAATGAPVTVDYPADYQPWQQAFDDSEAPFYRWFSGGLTNACFNEVDRHVTMGYGDEVAYYFEGDRWDNSLNNGRGGPVVQETITRRRLLVEVVKAAQVLRDLGLKKGDRIALNMPNIMPQIYYTEAAKRLGILYTPVFGGFSDKTLSDRIHNAGARVVITSDGAYRNAQVVPYKEAYTDQALDKYIPVETAQAIVAQTLATLPLTESQRQTIITEVEAALAGEITVERSDVMRGVGSALAKLRDLDASVQAKVRTVLAQALVESPPRVEAVVVVRHTGQEILWNEGRDRWSHDLLDAALAKILANARAAGFDVHSENDLLNLPDDQLIRALYASIPCEPVDAEYPMFIIYTSGSTGKPKGVIHVHGGYVAGVVHTLRVSFDAEPGDTIYVIADPGWITGQSYMLTATMAGRLTGVIAEGSPLFPSAGRYASIIERYGVQIFKAGVTFLKTVMSNPQNVEDVRLYDMHSLRVATFCAEPVSPAVQQFGMQIMTPQYINSYWATEHGGIVWTHFYGNQDFPLRPDAHTYPLPWVMGDVWVAETDESGTTRYRVADFDEKGEIVITAPYPYLTRTLWGDVPGFEAYLRGEIPLRAWKGDAERFVKTYWRRGPNGEWGYIQGDFAIKYPDGSFTLHGRSDDVINVSGHRMGTEEIEGAILRDRQITPDSPVGNCIVVGAPHREKGLTPVAFIQPAPGRHLTGADRRRLDELVRTEKGAVSVPEDYIEVSAFPETRSGKYMRRFLRNMMLDEPLGDTTTLRNPEVLEEIAAKIAEWKRRQRMAEEQQIIERYRYFRIEYHPPTASAGKLAVVTVTNPPVNALNERALDELNTIVDHLARRQDVAAIVFTGQGARSFVAGADIRQLLEEIHTVEEAMALPNNAHLAFRKIERMNKPCIAAINGVALGGGLEFAMACHYRVADVYAEFGQPEINLRLLPGYGGTQRLPRLLYKRNNGTGLLRALEMILGGRSVPADEALELGLIDAIATGDQDSLSLACALARAAIGADGQLIESAAVTQAFRHRHEQLDEWRKPDPRFADDELRSIIAHPRIERIIRQAHTVGRDAAVHRALDAIRYGIIHGFEAGLEHEAKLFAEAVVDPNGGKRGIREFLDRQSAPLPTRRPLITPEQEQLLRDQKELLPVGSPFFPGVDRIPKWQYAQAVIRDPDTGAAAHGDPIVAEKQIIVPVERPRANQALIYVLASEVNFNDIWAITGIPVSRFDEHDRDWHVTGSGGIGLIVALGEEARREGRLKVGDLVAIYSGQSDLLSPLMGLDPMAADFVIQGNDTPDGSHQQFMLAQAPQCLPIPTDMSIEAAGSYILNLGTIYRALFTTLQIKAGRTIFIEGAATGTGLDAARSAARNGLRVIGMVSSSSRASTLLAAGAHGAINRKDPEVADCFTRVPEDPSAWAAWEAAGQPLLAMFRAQNDGRLADYVVSHAGETAFPRSFQLLGEPRDGHIPTLTFYGATSGYHFTFLGKPGSASPTEMLRRANLRAGEAVLIYYGVGSDDLVDTGGLEAIEAARQMGARIVVVTVSDAQREFVLSLGFGAALRGVVSLAELKRRFGDEFEWPRTMPPLPNARQDPQGLKEAVRRFNDLVFKPLGSAVGVFLRSADNPRGYPDLIIERAAHDALAVSAMLIKPFTGRIVYFEDIGGRRYSFFAPQIWVRQRRIYMPTAQIFGTHLSNAYEILRLNDEISAGLLTITEPAVVPWDELPEAHQAMWENRHTAATYVVNHALPRLGLKNRDELYEAWTAGER

SEQ ID NO: 120 - protein, 535 aa, Chloroflexus aggregans (strain MD-66 / DSM 9485)
MSIIHSHIQTNSADFQANFAYHQALAADLRERLAKIRQGGGPEQRRRHEERGKLFVRDRIDTLIDPDSAFLEIGALAAYNVYDEEVPAAGIVCGIGRVTGRPVMIIANDATVKGGTYFPLTVKKHLRAQEIARENRLPCIYLVDSGGAYLPLQSEVFPDRDHFGRIFYNQAQMSAEGIPQIACVMGSCTAGGAYVPAMSDEVVIVKGNGTIFLGGPPLVKAATGEEVTAEELGGADVHTRISGVADYFANDDREALAIVRDIVAHLGPRQRAQWELRDPEPPRYDPHEIYGILPRDFRQSYDVREVIARIVDGSRLHEFKARYGTTLVCGFAHIEGFPVGILANNGILFSESALKGAHFIELCCARNIPLVFLQNITGFMVGKQYENGGIAKDGAKLVTAVSCANVPKFTVIIGGSFGAGNYGMCGRAFQPRQLWMWPNARISVMGGMQAANVLLTVRRDNLRARGQDMTPEEQERFMAPILAKYEQEGHPYYASARLWDDGVIDPVETRRVLALGLAAAAEAPIQPTRFGVFRM

SEQ ID NO: 121 - protein, 1912 aa, Roseiflexus castenholzii (strain DSM 13941 / HLO8); identical to SEQ ID NO: 9

SEQ ID NO: 122 - protein, 1804 aa, Natronococcus occultus
MSERADEGASSTDDVRSNPIRTRDDWEQYRERAREDPGSFHGSIAKREIHWYHDDEDAWLSYDGEWTGFDAETGARTSRDYPEGHEPWDVAFDDSEAPLYEWFAGGLTNACFNEVDRHVLAGHGDETAFHFEGDRWDQSKNDGRGGPVVSEDVSRRELLVRVAEAAQVLQNLGLERGDRIALNMPNIMEQLYYTEAAKRLGIVYTPVFGGFSDKTLSDRIARLGADVLITSDGGYRNAEIVPYKERYADPALEDYLPVETVLEIVDETLAELELDERHAETIRERVERAIEGEATVDRGQAMRGVGNALETFADRSGEELAEIRTEIARALVDSEDRLERVVVVEHTGQEIQTHDRDDWSADLIADAREDILAQARDAGFALESYDDLLALEDRELVRAIWASSRPVPVDAEYPLFVIFTSGSTGKPKGVVHVHGGYTAGIANTMKVSFDVVPGEDTIFVIADPGWITGQSYLISASLTTRTTSVLLEGAPVYPDAGRFSSVIERYGATVFKAGVTFLKGIMEDDESVADMREWETDSLRVATFCAEPVSPAVQEFGMEEICERYINSYWATEHGGIVWTHFFGNEDFELRADAHTYPLPWVFGNVWVEEEEHPDGTSEWREADPEERGEIIVEEPYPYLMRYVWGDLEGWDGADWAGEWTGNAERFEDVYWIEKDGEYAYLQGDVAKQYDDDSFSLHGRSDEVINVSGHRMGTEEIEGAILQDKRINPDSPVANAVVVGADHHEKGLTPVAFVQTKPDDRLTNEVEARLSGLVRDEKGVTAVPETFIEVEAFPETRSGKYMRRMLTAMLDREPIGDTSTLKNPGVVESIRPKCERWRRRQELAAEQELLEQYRNVTVQYNDVRGADERIATVTIDSPPVNALTERALDELNTVLEHLDRREDVGAVVLTGAGPSNFVAGADVEQFLEEVHEYEDAVAFPNTAHEAFRRIEELSVPVVAAVNGTALGGGNELQLAAHYSVAEQAAEFGQPELNLNLIPGYGGTQRLPRVLGERRGTDGVRDAVTLITNGRTVDAEDALEMGLVDELETERTARIRAAALAREHVTDAGDTLADARERRLENRSAWADPGEFPADVLEDPIVERNRRQCDHAGTGRAKAFERAVEAIRVGFEEGIDAGLEREATHFAEAVVDPEGGKAGIEAFLDRASEPLPTRERFSPSPEEEQALLEDGRLLPPGEPFYPGVDEIPDYQYAQLVRKDDETGEAAHGDPEEAELEEVVPVEEPGPNEVLVYVLASEVNFNDIWAITGVPVSQFENHDQDYHVTGSGGVALVVDAGEAVVREGRVSVGDLVTIYSGQSDLLSPRMGLDPMYADFSIQGYEGPNGSHQQFMLAQGPQVLPIPEEATIEQAGAYVLATGTVWRALFTTLDIEPETSMFVEGASTGTGWETTKLATRNDVDVTGLCSSEERAERIERLGADALDRTADPYDDIWGRIPREENAWDDWKEAGREFVEAYEANHDGERADYAVSHAGELSFPRSFQLLEEGGKLTFYGASTGYYLTFLGKPGASTPDAMFERADVRAGDGVLIYYGTDTGPDGVVDETGLRAIEDAREAGTRIAVVASTDEQAEFVESLGFGDAVEGTVSIEGLQRREDDFRWPETLPDLPDAQADPEAFRGVVQSITDEVFKPLGKAVGELLGTPKNPRGYPDVVFERADHDALYVSTMLAKPHTGRVVYSEDLEDRRYSMYAPQVWMRQREVLMPTAEILGTHLSNAYEVEQLNEAVDAGEIDLTDPEVVGWDELPEAHQAMWDNEHEASSYVAAHALPEDGLDSKEELFLAWADRER

SEQ ID NO: 123 - protein, 1850 aa, Erythrobacter sp. NAP1
MIGEGDDIGSSNNLEKQSHGLRISDRDHFQRLREECRSDPGEFHGRLAKREICWLIEGPGGNPAWAFYDDAAETWTGWDASSAAPITLDLPESFEPWERAFNDDDPPNWRWFEGGLTSTAFNEVDRHVLSGHGDEAAMIFEGDRWNMASEGGRGGPVDSEVISRRKLLLESAKCALALKALGLEAGDRIALNMPSIPEQIYWTEGAKRMGIVYTPVFGGFSDKTLSDRIADAGARVVVTADGSYRNAQMVPFKPSYTDPALDNFIAVPVAMELLGQALEDGELVVAPEHAGLIRSEVAGLLDGEVTVERSDVMRGVGKALTAIASGEAAGGAMTPRQAAQLRIAIASALVDSPPRVDAVVVVKHTAQPDLPWNEARDHWSHDLTAAAGEELLKAARDAGFDVADEEALLALSDTEFVRAIWAGAPVLAVDAEYPNFIIYTSGSTGKPKGVVHVHGGYASGVAATMPAAFGAEPGDVMYVVADPGWITGQSYQIAASLLSRVTTVITEGSPVFPHAGRFASIIERYGVNVFKAGVTFLKSVMQNPENLKDIQRYDLSSLKVATFCAEPVSPAVQAFAMEHITHRYINSYWATEHGGMVWTHFADADGFPLEADAHTYPLPWIMGDVWVEDADGSSNGPVEYERDTGTGGAPWRVAEDGEKGEIVIALPYPYLTRTIWGDVENFTVEHVGNLARVAGGWRGDEVRYADTYWRRWKGAWAYTQGDFAMRHPDGSFSLHGRSDDVINVSGHRIGTEEIEGAILRDKALDPNSPVGNVIVIGAPHSQKGVTPIAFVTPVEGRRLTQDDKRRLTDLVRTEKGAVAVPQDFIELSEFPETRSGKYMRRMVRAVVEGGEVGDASTLRNPESLDELARAVDGWKRRQSLSDTQALFERYRFFTIQYNLVAPGKRVATVTVKNPPVNALNERALDELVIIAEHLARKDDVAAVVFTGSGTASFVAGADIRQMLEEVNSVEEAKALPDNAQLAFRTIEEMDKPCIAAIQGVALGGGMEFALACHYRVAEPKARFGQPEINLRLLPGYGGTQRLPRLLADGGGETGLRDALDLILGGRAIDADAALAVGAVDALADGSDNALSHAHAMVREFVRSGDDSALGKAFAARKTQTQSWHEPASIDLDAVLEDEFLQRILNQLEWAGRDKAGERALDAVRTGWTQGMTAGLECEAQRFAEAIIDPEGGKTGIQQFMDKQSPPLPVRRDGVWEDDQHEATKTALIEAGDLLPLGAPFYPGVTAIPPKQLAFGIARDPDTGAPRFGPPETHERELVVNTPKPGANEALIYLLSSEVNFNDIWALTGIPVSPFDAHDEDVQITGSGGLALVAALGSELKEEGRLQVGDLVSVYSGTSELLSPLAGDDPMYAGFAIQGYETKTGSHAQFLTVQGPQLHRPPADLTLEQAGAYTLNLGTVARCLFTTLEIQAGKTAFVEGSATGTGLDALKSSVRTGLAVTGLVSSEDRAEFVKSHGSVGAINRKDPEIADCFTPVPDDPDEARQWEADGEKLLDAYRETNGGKLADYVVSHAGERAFPRSFQLLAEGGRLAFYGASSGYHFSFMGKGGEARPDEMLARANLRGGESVLLYYGPGSHELADEKGLEMVEAARLMKARMVIVTTSDGQREFLQSLGLEDAVEGIVSIEGLKRRLSDFHWPDTLPRLPDARTDIENFKIGVRAYQQNTMKPFGTAVGKLLRSPGNPRGVPDLVIERAGQDTLGVSTSLVKPFGGRVIYAEEMAGRRYTFYAPQVWTRQRRIYMPSAEIFGTHLCNAYEVTMMNEMVAAGLLDVTEPTMVPWEGLPEAHQAMWDNRHSGATYVVNHALPAMGLTTKDELLEYWVAAQSDTGETS

SEQ ID NO: 124 - protein, 542 aa, Cupriavidus necator (strain ATCC 17699 / H16 / DSM 428 / Stanier 337)
MKVITAREAAALVQDGWTVASAGFVGAGHAEAVTEALEQRFLQSGLPRDLTLVYSAGQGDRGARGVNHFGNAGMTASIVGGHWRSATRLATLAMAEQCEGYNLPQGVLTHLYRAIAGGKPGVMTKIGLHTFVDPRTAQDARYHGGAVNERARQAIAEGKACWVDAVDFRGDEYLFYPSFPIHCALIRCTAADARGNLSTHREAFHHELLAMAQAAHNSGGIVIAQVESLVDHHEILQAIHVPGILVDYVVVCDNPANHQMTFAESYNPAYVTPWQGEAAVAEAEAAPVAAGPLDARTIVQRRAVMELARRAPRVVNLGVGMPAAVGMLAHQAGLDGFTLTVEAGPIGGTPADGLSFGASAYPEAVVDQPAQFDFYEGGGIDLAILGLAELDGHGNVNVSKFGEGEGASIAGVGGFINITQSARAVVFMGTLTAGGLEVRAGDGGLQIVREGRVKKIVPEVSHLSFNGPYVASLGIPVLYITERAVFEMRAGADGEARLTLVEIAPGVDLQRDVLDQCSTPIAVAQDLREMDARLFQAGPLHL

SEQ ID NO: 125 - protein, 524 aa, Anaerotignum propionicum
MRKVPIITADEAAKLIKDGDTVTTSGFVGNAIPEALDRAVEKRFLETGEPKNITYVYCGSQGNRDGRGAEHFAHEGLLKRYIAGHWATVPALGKMAMENKMEAYNVSQGALCHLFRDIASHKPGVFTKVGIGTFIDPRNGGGKVNDITKEDIVELVEIKGQEYLFYPAFPIHVALIRGTYADESGNITFEKEVAPLEGTSVCQAVKNSGGIVVVQVERVVKAGTLDPRHVKVPGIYVDYVVVADPEDHQQSLDCEYDPALSGEHRRPEVVGEPLPLSAKKVIGRRGAIELEKDVAVNLGVGAPEYVASVADEEGIVDFMTLTAESGAIGGVPAGGVRFGASYNADALIDQGYQFDYYDGGGLDLCYLGLAECDEKGNINVSRFGPRIAGCGGFINITQNTPKVFFCGTFTAGGLKVKIEDGKVIIVQEGKQKKFLKAVEQITFNGDVALANKQQVTYITERCVFLLKEDGLHLSEIAPGIDLQTQILDVMDFAPIIDRDANGQIKLMDAALFAEGLMGLKEMKS

SEQ ID NO: 126 - protein, 517 aa, Megasphaera elsdenii DSM 20460
MRKVEIITAEQAAQLVKDNDTITSIGFVSSAHPEALTKALEKRFLDTNTPQNLTYIYAGSQGKRDGRAAEHLAHTGLLKRAIIGHWQTVPAIGKLAVENKIEAYNFSQGTLVHWFRALAGHKLGVFTDIGLETFLDPRQLGGKLNDVTKEDLVKLIEVDGHEQLFYPTFPVNVAFLRGTYADESGNITMDEEIGPFESTSVAQAVHNCGGKVVVQVKDVVAHGSLDPRMVKIPGIYVDYVVVAAPEDHQQTYDCEYDPSLSGEHRAPEGATDAALPMSAKKIIGRRGALELTENAVVNLGVGAPEYVASVAGEEGIADTITLTVEGGAIGGVPQGGARFGSSRNADAIIDHTYQFDFYDGGGLDIAYLGLAQCDGSGNINVSKFGTNVAGCGGFPNISQQTPNVYFCGTFTAGGLKIAVEDGKVKILQEGKAKKFIKAVDQITFNGSYAARNGKHVLYITERCVFELTKEGLKLIEVAPGIDIEKDILAHMDFKPIIDNPKLMDARLFQDGPMGLKK

SEQ ID NO: 127 - protein, 628 aa, Salmonella typhimurium (strain LT2 / SGSC1412 / ATCC 700720)
MSFSEFYQRSINEPEAFWAEQARRIDWRQPFTQTLDHSRPPFARWFCGGTTNLCHNAVDRWRDKQPEALALIAVSSETDEERTFTFSQLHDEVNIVAAMLLSLGVQRGDRVLVYMPMIAEAQITLLACARIGAIHSVVFGGFASHSVAARIDDARPALIVSADAGARGGKILPYKKLLDDAIAQAQHQPKHVLLVDRGLAKMAWVDGRDLDFATLRQQHLGASVPVAWLESNETSCILYTSGTTGKPKGVQRDVGGYAVALATSMDTIFGGKAGGVFFCASDIGWVVGHSYIVYAPLLAGMATIVYEGLPTYPDCGVWWKIVEKYQVNRMFSAPTAIRVLKKFPTAQIRNHDLSSLEALYLAGEPLDEPTASWVTETLGVPVIDNYWQTESGWPIMALARALDDRPSRLGSPGVPMYGYNVQLLNEVTGEPCGINEKGMLVIEGPLPPGCIQTIWGDDARFVKTYWSLFNRQVYATFDWGIRDAEGYYFILGRTDDVINIAGHRLGTREIEESISSYPNVAEVAVVGIKDALKGQVAVAFVIPKQSDTLADREAARDEENAIMALVDNQIGHFGRPAHVWFVSQLPKTRSGKMLRRTIQAICEGRDPGDLTTIDDPASLQQIRQAIEE

SEQ ID NO: 128 - protein, 705 aa, Nitrosopumilus maritimus (strain SCM1)
MAAVKKIFDEIIETDHKVITEESSKSILKNYGVKVPPYALVTSAEEAAKEAKKIGFPLVMKVVSPQILHKTDVGGVKVGLDNVADVKKTFTDMYGRLSKKKGVNVKGILLEKMVPKGVELIVGIQNDSQFGPIIMVGMGGIMTEVMKDVAFRMLPITTSDAKSMLNELKGSKLLKGFRGSEPIDTNLVAKMLVNIGKLGVENADYINSIDFNPVIVYPKSHYVVDAKIILNKEKKKNSISKAKPSITDMETFFTPKSVALVGASASPGKIGNSILDSLVNYDFKGKVYPINPKADKIFGQKCYPSVADIPGKVDLVVVSVDLSMTPPVLEDCAKKGVHSVVIVSGGGKELGGERAAYEAEVARLSKKHKIRIIGPNCIGMFNAANRLDCAFQGQERMVRSKLGPVAFFSQSGTMGISMLESADTFGLSKMISFGNRSDVDEADMIWYAANDPQTKVIGLYVEGFGDGRKFINVAKRVMKEKKKPIVIWKSGRTAAGAKQAASHTGSLGGSNAIIMGAFKQAGIISVDSYQELAGVLKALAWQPAAKGNKVAMTSNGAGPMIGGIDQLEKFGLAIGKLSPKLLKKMKSRFPPAVPIHNGNPADVGGGATADDYQFVIQQFMDEKNIDIAMPWFVFQDDPLEETIVDHLAGFQKKAKKPLLCGGNGGPYTEKMIKLIEKHNVPVYQDLRTWVAAASALHQWGKISKK

SEQ ID NO: 129 - protein, 661 aa, Metallosphaera sedula (strain ATCC 51363 / DSM 5348 / JCM 9185 / NBRC 15509 / TH2)
MFMRYIMVEEQTLKTGSQELEEKADYNMRYYAHLMKLSKEKPAEFWGSLAQDLLDWYEPWKETMRQEDPMTRWFIGGKINASYNAVDRHLNGPRKFKAAVIWESELGERKIVTYQDMFYEVNRWANALRSLGVGKGDRVTIYMPLTPEGIAAMLASARIGAIHSVIFAGFGSQAIADRVEDAKAKVVITADAYPRRGKVVELKKTVDEALNSLGERSPVQHVLVYRRMKTDVNMKEGRDVFFDEVGKYRYVEPERMDSNDPLFILYTSGTTGKPKGIMHSTGGYLTGTAVMLLWSYGLSQENDVLFNTSDIGWIVGHSYITYSPLIMGRTVVIYESAPDYPYPDKWAEIIERYRATTFGTSATALRYFMKYGDEYVKNHDLSSIRIIVTNGEVLNYSPWKWGLEVLGGGKVFMSHQWWQTETGAPNLGYLPGIIYMPMKSGPASGFPLPGNFVEVLDENGNPSAPRVRGYLVMRPPFPPNMMMGMWNDNGERLKKTYFSKFGSLYYPGDFAMVDEDGYIWVLGRADETLKIAAHRIGAGEVESAITSHPSVAEAAVIGVPDSVKGEEVHAFVVLKQGYAPSSELAKDIQSHVRKVMGPIVSPQIHFVDKLPKTRSGKVMRRVIKAVMMGSSAGDLTTIEDEASMDEIKKAVEELKKELKTS

SEQ ID NO: 130 - protein, 628 aa, Escherichia coli (strain K12) [sequence omitted]

SEQ ID NO: 131 - protein, 542 aa, Cupriavidus necator (strain ATCC 17699 / H16 / DSM 428 / Stanier 337); identical to SEQ ID NO: 124

SEQ ID NO: 132 - protein, 659 aa, Sulfurisphaera tokodaii (strain DSM 16993 / JCM 10545 / NBRC 100140 / 7)
MTEKLSEQLQQLGEQNLEEKADYNMRYYKYLYKKSIEEPDKFWGELAEELITWYEPWKQAFVQEEGLLTKWFVGGKLNASYNAVDRHLNSHRKYKAAIFWESEKGEKKVVTYQDLFYEVNKWANALRELGVKKGDRVTIYMPLTPEGVIAKLAVARLGAIHSVVFAGFGAQALADRIADAGAKVVITADAYYRRGKLVELKKTVDEALNILGDKSPVQKVLVYKRTGTEIPFKEGRDVYFDEVGKYKYIEPVPVEATEPLFILYTSGTTGKPKGIVHSTGGYLVGTAVMLLWSYGLSQENDVLFNTSDIGWIVGHSYITYSPLVMGRSIVIYESAPDYPYPDKWAEMIEKYRATTFGTSATAIRTLMKYGEDYVKQHDLSSLRIIVTNGEPLNYAPWKWGLEVVGGGKVFMSHQWWQTETGGPNIGYIPGVVYLPMKSGPAVGFALPGNKVTVVNEEGKETKPRERGYLVMLPPFPPMMMIGMWNDPDNERLKKTYFSKFPGIYYPGDYAMIDEDGYIWVMGRADETIKVAAHRIGAGEVESIVTSHPAVAEAAAVGIPDPVKGEAVHLFVVLKVGYKPSPQLAREIQEHVRKYMGAIVTPEVHFVDKLPKTRSGKIMRRVIKAVMMGQSAGDITTLEDEASMDEIKKAVEEFKKSLSQ

SEQ ID NO: 133 - protein, 259 aa, Metallosphaera sedula (strain ATCC 51363 / DSM 5348 / JCM 9185 / NBRC 15509 / TH2)
MEFETIETKKEGNLFWITLNRPDKLNALNAKLLEELDRAVSQAESDPEIRVIIITGKGKAFCAGADITQFNQLTPAEAWKFSKKGREIMDKIEALSKPTIAMINGYALGGGLELALACDIRIAAEEAQLGLPEINLGIYPGYGGTQRLTRVIGKGRALEMMMTGDRIPGKDAEKYGLVNRVVPLANLEQETRKLAEKIAKKSPISLALIKEVVNRGLDSPLLSGLALESVGWGVVFSTEDKKEGVSAFLEKREPTFKGK

SEQ ID NO: 134 - protein, 258 aa, Bacillus sp. FJAT-27225
MEFTNILTRTEEHIGWIIINRPEQRNALNLDTLLEIERALNLWRTNDDIRVVIITGAGEKSFAAGADISQLNKRTMIEALQPNMTATYRKIEDYEKPTIAAINGFALGGGLELALACDIRVASLNAKLGLPEVGLGIIPGAGGTQRLTRIIGKGKAMELILTGDIITAEEAEKLGIVSKAVPKEELLETATLYANKLTKKAPLALRLAKAAVNRGADIEMETALYIEKLSQTILMGSDDKREGTEAFLEKRQPNFKGK

SEQ ID NO: 135 - protein, 259 aa, Sporanaerobacter acetigenes DSM 13106
MDFENLIFKREGNIGILSINRPKALNALNTQVLCELDKAIDMIENDEDIHILIITGEGRAFVAGADIAEMKEMNSKEARQFAKNGLGVFRKIELMEKPVIAAVNGFALGGGCELSMCCDIRIASEKAKFGQPEVGLGIIPGFAGTQRLARLVGMGRAKELIFTSDMIDANEAYRIGLVNKVVPQDELMNEAIALANKILSKGQIAVRFAKTSINRGMETDIETGMAIERDLFGLCFATEDQKEGMGAFLEKRSPNYKLR

SEQ ID NO: 136 - protein, 309 aa, Ruegeria pomeroyi (strain ATCC 700808 / DSM 15171 / DSS-3)
MTWRCILSTLPCMLCWGAVREEDMSVVAYEKDGRIARITLNRPEVMNAINDELPGALAAAVAQADADPGVHVMVLSGAGRAFCAGYDLTYYAEGNGAGEVTQPMPWDPIKDYRFMWANTQHFMSLWRAAKPVVCKVHGFAVAGGSDIALCADMTIMAEDAQIGYMPSRVWGCPTTAMWVYRLGAERAKRMLFTGDKITGRQAADMGLVLEAVPAEHLDDRVEELAARMATVPINQLAMQKLVINQAIEQTGLMQTQRLATIFDGITRHSPEGIHFKERAEAVGWKQAVDERDQGTWDWTANAEIPKGNR

SEQ ID NO: 137 - protein, 257 aa, Sulfurisphaera tokodaii (strain DSM 16993 / JCM 10545 / NBRC 100140 / 7)
METIVIKKETPIGWIYLNRPDRLNAINQQMIKELRQGIDEMVYDSDIKVIIITGNGKAFSAGADISRFKELNGYTAWQFAKSGRELMDYIENISKPTIAMVNGYALGGGLELAMACDIRIAAEEAQLGLPEINLGIYPGFGGTQRLVRLIGKGKALELMLTGDRISAKEAEKIGLVNKVVPLSNLEQETRNFALKLAEKPPISIALIKLLVNQGIDLPILAGLNMESLGWGVVFSTEDEKEGVSAFLEKRKAQFKGK

SEQ ID NO: 138 - protein, 253 aa, Nitrosopumilus maritimus (strain SCM1)
MSLVTTSTSDGICTVKINRPDKLNAMNTDVAKELIKTFEELNHNDDVKVIILTGEGEKAFSAGADIEYMSKISADESVEYAKTGQLVTATVELVKQPTIAAVNGFALGGGCELAMSCDIRIAADTAKLGQPEVTIGVPPGWGGTQRLMRIVGIAKAKELVYTGKMIKAEEAKEIGLVNHVVPLASLQEEALKMAQQIAGNSTMGVQMSKVAINKGRNADLDTGLGLEILAWRNCFTHPDRQERMTAFVNKSKK

SEQ ID NO: 139 - protein, 201 aa, Clostridium acetobutylicum (strain ATCC 824 / DSM 792 / JCM 1419 / LMG 5710 / VKM B-1787)
SFVAGADISEMKEMNTIEGRKFGILGNKVFRRLELLEKPVIAAVNGFALGGGCEIAMSCDIRIASSNARFGQPEVGLGITPGFGGTQRLSRLVGMGMAKQLIFTAQNIKADEALRIGLVNKVVEPSELMNTAKEIANKIVSNAPVAVKLSKQAINRGMQCDIDTALAFESEAFGECFSTEDQKDAMTAFIEKRKIEGFKNR

SEQ ID NO: 140 - protein, 275 aa, Clostridium pasteurianum
MENNNSKSNIIVHIILIIGAFAMLLPFLWMIITSLKTLTESTQVPPTFIPKIFNIGNYSDVWNQLPFASFYVNTFLMMLFRIIFSVFFSAMAAYAFARIEFPGKNAFFMIILIQMMIPGQIFIIPQYLIVSKLGLLNSVGALVVPGIVSAFGTFLLRQFFIGIPVELEEAAVLDGCNRWQIFYKIMLPLTKSGLVAIGIFTALFAWKDLMWPLIVNTSIEKMPLASGLASLQGQYATNFPQLMAGSMIAIWPMLILFIIFQKQFIQGIASTGSKN

SEQ ID NO: 141 - protein, 22 aa, Clostridium pasteurianum
  misc_feature (13)..(13): Xaa can be any naturally occurring amino acid
  misc_feature (21)..(21): Xaa can be any naturally occurring amino acid
MGFNGGILEGEEXKAVVTINXP

SEQ ID NO: 142 - protein, 260 aa, Megasphaera elsdenii DSM 20460
MDYQNIIFAVEDGIATITINRPKALNALNQATVSELKDVVEKIAADKAIKVVIITGAGAKSFVAGADIKEMASKNAAEGREWGQFGQNVFTEIENLPQPVIAAINGFALGGGCELSCACDIRYAAENAKFGQPEVGLGITPGFGGTQRLTRVVGRGHAKELIYTGGMIDAEKAKAIGLVNEVFPQEELMPAAVKLAKKIAKNAPIAVQLSKAAINRGINCDVVTGIAYEAEVFGLCFSTADQKEGMAAFCEKRKATFEGK

SEQ ID NO: 143 - protein, 255 aa, Anoxybacillus flavithermus (strain DSM 21510 / WK1)
MFSIQQEGYVAILALHRPPANALASSVLKELSERLDALKEDEQVRVIVLHGEGRFFSAGADIKEFTAIEASEQAAELARAGQQVMEKIEQFPKPIIAAIHGAALGGGLELAMSCHLRIVAENAKLGLPELQLGIIPGFAGTQRLLRHVGMAKALEMMWTSEPITGAEAVQWGLANKAVPEEQLLDTAKQLAQKIAQKSPISVQAVLKLVNEARTKTFHECVEKEAQLFGQVFVTEDAKEGISAFIEKRTPQFQGK

SEQ ID NO: 144 - protein, 330 aa, Ruegeria pomeroyi (strain ATCC 700808 / DSM 15171 / DSS-3)
MFNALVVDKDEESGKTQAAVKQLSLTDLPVGEVTVAVEYSTVNYKDGLCIGPGGGLVRKYPHVPGIDFAGTVENSSDERYKPGDKVVLTGWRVGEAHWGGYSQKANVRADWLVPLPEGLDTRQAMAVGTAGFTAMLAVMALEDHGLTPGHGPVLVTGAAGGVGSVATAILAHLGYEVAAVTGRPETADYLTSLGATQIVARDEINETVKRPLESEIWAGCVDAVGGAMLARVLGQMKYGASVAAVGLAGGAGLPATVIPFLLRGVNLLGIDSVMQPYANRLRAWERIARDLPMDKLEAMIRPATLSDLPGLGADILKGQVQGRVVVDVNA

SEQ ID NO: 145 - protein, 324 aa, Escherichia coli (strain K12)
MQALLLEQQDGKTLASVQTLDESRLPEGDVTVDVHWSSLNYKDALAITGKGKIIRNFPMIPGIDFAGTVRTSEDPRFHAGQEVLLTGWGVGENHWGGLAEQARVKGDWLVAMPQGLDARKAMIIGTAGFTAMLCVMALEDAGVRPQDGEIVVTGASGGVGSTAVALLHKLGYQVVAVSGRESTHEYLKSLGASRVLPRDEFAESRPLEKQVWAGAIDTVGDKVLAKVLAQMNYGGCVAACGLAGGFTLPTTVMPFILRNVRLQGVDSVMTPPERRAQAWQRLVADLPESFYTQAAKEISLSEAPNFAEAIINNQIQGRTLVKVN

SEQ ID NO: 146 - protein, 326 aa, Rhodobacter sphaeroides (strain ATCC 17023 / 2.4.1 / NCIB 8253 / DSM 158)
MRAVLIEKSDDTQSVSVTELAEDQLPEGDVLVDVAYSTLNYKDALAITGKAPVVRRFPMVPGIDFTGTVAQSSHADFKPGDRVILNGWGVGEKHWGGLAERARVRGDWLVPLPAPLDLRQAAMIGTAGYTAMLCVLALERHGVVPGNGEIVVSGAAGGVGSVATTLLAAKGYEVAAVTGRASEAEYLRGLGAASVIDRNELTGKVRPLGQERWAGGIDVAGSTVLANMLSMMKYRGVVAACGLAAGMDLPASVAPFILRGMTLAGVDSVMCPKTDRLAAWARLASDLDPAKLEEMTTELPFSEVIETAPKFLDGTVRGRIVIPVTP

SEQ ID NO: 147 - protein, 330 aa, Ruegeria pomeroyi (strain ATCC 700808 / DSM 15171 / DSS-3); identical to SEQ ID NO: 144

SEQ ID NO: 148 - protein, 326 aa, Rhodobacter sphaeroides (strain ATCC 17023 / 2.4.1 / NCIB 8253 / DSM 158); identical to SEQ ID NO: 146

SEQ ID NO: 149 - protein, 394 aa, Anaerotignum propionicum
MFLLKIKKERMKRMDFSLTREQEMLKKLARQFAEIELEPVAEEIDREHVFPAENFKKMAEIGLTGIGIPKEFGGSGGGTLEKVIAVSEFGKKCMASASILSIHLIAPQAIYKYGTKEQKETYLPRLTKGGELGAFALTEPNAGSDAGAVKTTAILDSQTNEYVLNGTKCFISGGGRAGVLVIFALTEPKKGLKGMSAIIVEKGTPGFSIGKVESKMGIAGSETAELIFEDCRVPAANLLGKEGKGFKIAMEALDGARIGVGAQAIGIAEGAIDLSVKYVHERIQFGKPIANLQGIQWYIADMATKTAAARALVEFAAYLEDAGKPFTKESAMCKLNASENARFVTNLALQIHGGYGYMKDYPLERMYRDAKITEIYEGTSEIHKVVIAREVMKR

SEQ ID NO: 150 - protein, 333 aa, Alcaligenes faecalis
MHGKDFQALVTRQNGETVSNALEWRSPVSLSPGEVRIRTAYAGVNYKDCLAIQGLARIIRDFPRVGGIEAVGQIIESANSSFAVGDPVMAHGFDMGISQDGGFAQQLHVSGDHVQKIPSGLSLREAAVLGVPGFTVGLALDRFEAQGLTPQSGPVAVSGANGAVGMLTIALLAQAGYEVVALTRRTELAPALQQLGASEVLDTAITQSNRPLETARFAAAIDNVGGAVLSWLLRSMSDSGQIASVGNAAGNTFEGSVLPFFVRRVQIFGVLANAPWEQRYRVWNRLATEWRPDFALLEPYVHVVELADVPDLVQRQLEGAAHGRSLVAYGDVL

SEQ ID NO: 151 - protein, 334 aa, Sulfurisphaera tokodaii (strain DSM 16993 / JCM 10545 / NBRC 100140 / 7)
MKAIVVPGPKQGYKLEEVPDPKPGKDEVIIRVDRAALCYRDLLQLQGYYPRMKYPVILGHEVVGTIEEVGENIKGFEVGDKVISLLYAPDGTCEYCQIGEEAYCHHRLGYSEELDGFFAEKAKIKVTSLVKVPKGTPDEGAVLVPCVTGMIYRGIRRAGGIRKGELVLVTGASGGVGIHAIQVAKALGAKVIGVTTSEEKAKIIKQYADYVIVGTKFSEEAKKIGDVTLVIDTVGTPTFDESLKSLWMGGRIVQIGNVDPSQIYNLRLGYIILKDLKIVGHASATKKDAEDTLKLTQEGKIKPVIAGTVSLENIDEGYKMIKDKNKVGKVLVKP

SEQ ID NO: 152 - protein, 324 aa, Escherichia coli (strain K12); identical to SEQ ID NO: 145

SEQ ID NO: 153 - protein, 332 aa, Metallosphaera sedula (strain ATCC 51363 / DSM 5348 / JCM 9185 / NBRC 15509 / TH2)
MKAVVVKGHKQGYEVREVQDPKPASGEVIIKVRRAALCYRDLLQLQGFYPRMKYPVVLGHEVVGEILEVGEGVTGFSPGDRVISLLYAPDGTCHYCRQGEEAYCHSRLGYSEELDGFFSEMAKVKVTSLVKVPTRASDEGAVMVPCVTGMVYRGLRRANLREGETVLVTGASGGVGIHALQVAKAMGARVVGVTTSEEKASIVGKYADRVIVGSKFSEEAKKEDINVVIDTVGTPTFDESLKSLWMGGRIVQIGNVDPTQSYQLRLGYTILKDIAIIGHASATRRDAEGALKLTAEGKIRPVVAGTVHLEEIDKGYEMLKDKHKVGKVLLTT

SEQ ID NO: 154 - protein, 361 aa, Nitrosopumilus maritimus (strain SCM1)
MKKIMKALVYEEYTTDDDFSKILKIKDLPIPEPKSNEVVFKVKAAALNYDDIWGMRGKPLAIPLPHISGTDAAGEVTAVGEDVKNFKVGDRVVSHGNMSCRVCKRCTSGREYDCKKRTIWGFETGPLWGGYCEYTHLPEVNVVKIPEGISYEEAAAASMTMLTSWHMLVGRAKIQPGQLVLIMGGGSGVGNYGIQIAKLFGCTVIATASPDKLDQLLELGADYAIDHRKEDWHKEVRAIAKKLPKPFGEVPGVDVIFEHIGGSHWNKELTLLNYGGTVITTGATTGYMAKTDLRHIFFKGLNILGSTQGTRAELEEGFYWMSKGKIKSIIDSEYTLEQAAEAHTKMLKGKGLFGKIIMKPN

SEQ ID NO: 155 - protein, 858 aa, Clostridium acetobutylicum
MKVTNQKELKQKLNELREAQKKFATYTQEQVDKIFKQCAIAAAKERINLAKLAVEETGIGLVEDKIIKNHFAAEYIYNKYKNEKTCGIIDHDDSLGITKVAEPIGIVAAIVPTTNPTSTAIFKSLISLKTRNAIFFSPHPRAKKSTIAAAKLILDAAVKAGAPKNIIGWIDEPSIELSQDLMSEADIILATGGPSMVKAAYSSGKPAIGVGAGNTPAIIDESADIDMAVSSIILSKTYDNGVICASEQSILVMNSIYEKVKEEFVKRGSYILNQNEIAKIKETMFKNGAINADIVGKSAYIIAKMAGIEVPQTTKILIGEVQSVEKSELFSHEKLSPVLAMYKVKDFDEALKKAQRLIELGGSGHTSSLYIDSQNNKDKVKEFGLAMKTSRTFINMPSSQGASGDLYNFAIAPSFTLGCGTWGGNSVSQNVEPKHLLNIKSVAERRENMLWFKVPQKIYFKYGCLRFALKELKDMNKKRAFIVTDKDLFKLGYVNKITKVLDEIDIKYSIFTDIKSDPTIDSVKKGAKEMLNFEPDTIISIGGGSPMDAAKVMHLLYEYPEAEIENLAINFMDIRKRICNFPKLGTKAISVAIPTTAGTGSEATPFAVITNDETGMKYPLTSYELTPNMAIIDTELMLNMPRKLTAATGIDALVHAIEAYVSVMATDYTDELALRAIKMIFKYLPRAYKNGTNDIEAREKMAHASNIAGMAFANAFLGVCHSMAHKLGAMHHVPHGIACAVLIEEVIKYNATDCPTKQTAFPQYKSPNAKRKYAEIAEYLNLKGTSDTEKVTALIEAISKLKIDLSIPQNISAAGINKKDFYNTLDKMSELAFDDQCTTANPRYPLISELKDIYIKSF

SEQ ID NO: 156 - protein, 864 aa, Clostridium beijerinckii
MRVTNPEELTKRIEQIREAQREFAKFSQEEVDEIFRQAAMAANNARITLAKMAVEESGMGIVEDKVIKNHFAAEYIYNQYKDTKTCGVIERDEMFGITHIAEPIGVIAAIVPTTNPTSTAIFKTLIALKTRNGIIISPHPRAKNSTIAAAKIVLEAAERAGAPKGIIGWIDEPSIELSRNVMAESDIILATGGPGMVRAAYSSGKPAIGVGAGNTPAIIDDTAHIKMAVNSILLSKTFDNGVVCASEQSIIAMESVYDEVLKELDERGAYILKGDEVDKVRSIILDSKGSLNSEIVGQSAYKIAKMAGVEISEAVKVLIGEVESPELEEPFSHEKLSPILGMYKAKTFDDALRLASRMIELGGFGHTSILYTNQVESVDRIEKFGVAMKTARTLINMPASQGAIGDIYNFKLAPSLTLGCGSWGGNSISENVGPKHLINVKRIAERRENMLWFRVPDKIYFKFGCLPVALEELNAMKKKRAFIVTDRVLFDLGYTHKITNILSENHIEYKIFSDVEPDPTLKAAKLGADAMRDFNPDVIIAIGGGSPMDAAKIMWVMYEHPDVRFEDLAMRFMDIRKRVYEFPPMGEKAILVAIPTSAGTGSEVTPFAVITDQQTGVKYPLADYALTPNMAIIDAELMMSMPKGLTAASGIDALVHAIEAYVSVLASEYTNGLALEAIRLTFKYLPDAYNGGTTNIKAREKMAHASSVAGMAFANAFLGICHSMAHKLGAFHHVPHGIANALLIDEVIRFNATDAPRKQAAFPQYKYPNAGWRYARIADYLNLGGNTEEEKVELLIKAIDDLKGKVGIPKSIKEFGVSEEKFYASMDEMVEQAFDDQCTGANPRYPLMSEIKEMYIKSYNVSNK

SEQ ID NO: 157 - protein, 878 aa, Salmonella typhimurium
MAVTNVAELNALVERVKKAQREYASFTQEQVDKIFRAAALAAADARIPLAKMAVAESGMGIVEDKVIKNHFASEYIYNAYKDEKTCGVLSEDDTFRTITIAEPIGIICGIVPTTNPTSTAIFKSLISLKTRNAIIFSPHPRAKEATNKAADIVSKALSLPARRKIRLARSINLPVELSNVDAPPGYIPDPATGSRHGYSCIQLGSTLSAIGQATLRLVLMKPLIDSNAACGLCLDAYNLCYRGNLCFCTSLFVVDSAYLHMRPDFRQHGGYMRRPELKAVQRYPEKWRSERAIVGQPAYKIAELAGFSVPETTKILIGEVTVVDESEPFAHEKLSPTLAMYRAKDFEEAVEKAEKLVAMGGIGHTSCLYTDQDNQPERVAYFGQMKNARILINTPASQGGIGDLYNFKLPPSLTLGCGSWGGNSISENVGPKHLIYKKTVAKRAENMWHKLPKSIYFRRGSLPIALDEVITDGHKRALIVTDRFCSTTVSDRSLCAERRGVETEVFFEVEAADPTLSVVRKGPELANSFKPDVIIAVGGVPRWTRGEIIGSCTNHPETRLIEERVRFMTSYRIYKFPKMVKAKCSPSTTTSGTGSKLHRLRLCPTTLLPQKYPLADYAVTPDMAIVDANLVMDMPNTLTRKGPLHRLTHAMERIVSVLASQSDGQALQALKEYFPASYHEGKNPVARERLHSAATIAPIAFANAFLGVCHWMAHKLPAQLHIPHGPFNARYRHSVRRAQSNPTKQVALSQYLYNFAAHRWPAERSIPRARTGIRPRKYKLVPVALCHVKGIKADLGIPKSIREAGVQEADFLAHVDKLSEDAFDDQCTGANPRYPLMSELKQILLDTYYGRDFTEGEVAAKKDVVAAPKAEKKAKKSA

SEQ ID NO: 158 - protein, 868 aa, Clostridium arbusti
MKVSNIDELNVRLEEIREAQRKFGTYTQEQVDEIFRQAAMAALDARIPLAKMAAEETGMGLVEDKVIKNHFAAEYIYNQYKDEKTCGVVETDKSYGITKIAEPIGIVAAVIPTTNPTSTAIFKTLISLKTRNAIMLSPHPRAKKSTIAAAKIILDAAVKAGAPEGIIGWIDEPSIELTQILMQEADITLATGGPSMVKSAYSSGKPAIGVGPGNTPVIIDESAHIKMAVSSVILSKTFDNGVICASEQSVIVLDSIYDEVRKEFAERGAYIIKESEIDKVRKTIFINGSINSKIVGQSAYKIAEMSGIKVPETARILIGEVTSVGKEEPFAHEKLSTVLAMYRAENFDDALDKAVTLVNLGGLGHTSAIYADIIKAKDKIDKFSNAMKTVRTFINIPAAQGASGDLYNFKIAPSFTLGCGSWGGNSVSENVGPKHLLNIKRVAERRENMLWFRVPEKVYFKFGCLQFALRELKDLNKKRAFIVTDKVLYDLGYADAITKVLEEIGVDFKVFTEVEPDPTLSTARKGTEEMMDFKPDTIISLGGGSAMDAAKIMWVMYEHPEVKFEDLAMRFMDIRKRIYNFPKLGEKAMMIAVATSAGTGSEVTPFAVITDEKTGVKYPLADYELTPNMAIVDAELMMNMPKGLTAASGIDALIHGIEAYTSVLASEYTNGLALEAIRLIFKYLPTAYAEGTTNEKAREKMAHASTMAGMAFANAFLGVCHSMAHKLGAEHHIAHGTANALLIEEVIRFNSADNPVKQAAYPQYKYPNAKWRYGKIADYLNLGGNTDDEKVELLIKAIHELKEKINIPMSIKDAGVSEKNFYATLDKMCELAFDDQCTGANPRYPLISEIKQMLITAFDKTEINTEIK

SEQ ID NO: 159 - protein, 891 aa, Escherichia coli (strain K12)
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFATHGGYLLQGKELKAVQDVILKNGALNAAIVGQPAYKIAELAGFSVPENTKILIGEVTVVDESEPFAHEKLSPTLAMYRAKDFEDAVEKAEKLVAMGGIGHTSCLYTDQDNQPARVSYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSIVRKGAELANSFKPDVIIALGGGSPMDAAKIMWVMYEHPETHFEELALRFMDIRKRIYKFPKMGVKAKMIAVTTTSGTGSEVTPFAVVTDDATGQKYPLADYALTPDMAIVDANLVMDMPKSLCAFGGLDAVTHAMEAYVSVLASEFSDGQALQALKLLKEYLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLETLKAELGIPKSIREAGVQEADFLANVDKLSEDAFDDQCTGANPRYPLISELKQILLDTYYGRDYVEGETAAKKEAAPAKAEKKAKKSA

SEQ ID NO: 160 - protein, 336 aa, Escherichia coli (strain K12)
MKAAVVTKDHHVDVTYKTLRSLKHGEALLKMECCGVCHTDLHVKNGDFGDKTGVILGHEGIGVVAEVGPGVTSLKPGDRASVAWFYEGCGHCEYCNSGNETLCRSVKNAGYSVDGGMAEECIVVADYAVKVPDGLDSAAASSITCAGVTTYKAVKLSKIRPGQWIAIYGLGGLGNLALQYAKNVFNAKVIAIDVNDEQLKLATEMGADLAINSHTEDAAKIVQEKTGGAHAAVVTAVAKAAFNSAVDAVRAGGRVVAVGLPPESMSLDIPRLVLDGIEVVGSLVGTRQDLTEAFQFAAEGKVVPKVALRPLADINTIFTEMEEGKIRGRMVIDFRH

SEQ ID NO: 161 - protein, 390 aa, Clostridium acetobutylicum (strain ATCC 824 / DSM 792 / JCM 1419 / LMG 5710 / VKM B-1787)
MVDFEYSIPTRIFFGKDKINVLGRELKKYGSKVLIVYGGGSIKRNGIYDKAVSILEKNSIKFYELAGVEPNPRVTTVEKGVKICRENGVEVVLAIGGGSAIDCAKVIAAACEYDGNPWDIVLDGSKIKRVLPIASILTIAATGSEMDTWAVINNMDTNEKLIAAHPDMAPKFSILDPTYTYTVPTNQTAAGTADIMSHIFEVYFSNTKTAYLQDRMAEALLRTCIKYGGIALEKPDDYEARANLMWASSLAINGLLTYGKDTNWSVHLMEHELSAYYDITHGVGLAILTPNWMEYILNNDTVYKFVEYGVNVWGIDKEKNHYDIAHQAIQKTRDYFVNVLGLPSRLRDVGIEEEKLDIMAKESVKLTGGTIGNLRPVNASEVLQIFKKSV

SEQ ID NO: 162 - protein, 348 aa, Saccharomyces cerevisiae (strain ATCC 204508 / S288c)
MSIPETQKAIIFYESNGKLEHKDIPVPKPKPNELLINVKYSGVCHTDLHAWHGDWPLPTKLPLVGGHEGAGVVVGMGENVKGWKIGDYAGIKWLNGSCMACEYCELGNESNCPHADLSGYTHDGSFQEYATADAVQAAHIPQGTDLAEVAPILCAGITVYKALKSANLRAGHWAAISGAAGGLGSLAVQYAKAMGYRVLGIDGGPGKEELFTSLGGEVFIDFTKEKDIVSAVVKATNGGAHGIINVSVSEAAIEASTRYCRANGTVVLVGLPAGAKCSSDVFNHVVKSISIVGSYVGNRADTREALDFFARGLVKSPIKVVGLSSLPEIYEKMEKGQIAGRYVVDTSK

SEQ ID NO: 163 - protein, 399 aa, Thermoanaerobacterium saccharolyticum (strain DSM 8691 / JW/SL-YS485)
MWETKVNPSKIFELRCKNTTYFGVGSIHKIKDILENLKINGINNVIFITGKGSYKTSGAWDVVRPVLEELDLKYSLYDKVGPNPTVDMIDEAAKIGRESGAKAVIGIGGGSPIDTAKSVAVLLKYTDKNARELYKQKFIPDDAVPIIAINLTHGTGTEVDRFAVATIPEKNYKPAIAYDCLYPMFAIDDPSLMTKLDKKQTIAVTVDALNHITEAATTLVASPYSILTAKETVRLIVRYLPAAVNDPLNIVARYYLLYASALAGISFDNGLLHLTHALEHPLSAVKPEIAHGLGLGAILPAVIKAIYPATAEVLADVYSPIVPGLKGLPVEAEYVAEKVQEWLFSVGCIQKLSDFGFTKDDIPNLVKLAKTTPSLDGLLSIAPVEATESVIEKIYLKSL

SEQ ID NO: 164 - protein, 500 aa, Saccharomyces cerevisiae (strain ATCC 204508 / S288c)
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLALARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 165 - protein, 453 aa, Homo sapiens
MSKISEAVKRARAAFSSGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGAIAAGNSVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDKVIKKMIAETSSGGVAANDVIVHITLHSLPFGGVGNSGMGSYHGKKSFETFSHRRSCLVRPLMNDEGLKVRYPPSPAKMTQH

SEQ ID NO: 166 - protein, 316 aa, Escherichia coli
MSKRKVAIIGSGNIGTDLMIKILRHGQHLEMAVMVGIDPQSDGLARARRMGVATTHEGVIGLMNMPEFADIDIVFDATSAGAHVKNDAALREAKPDIRLIDLTPAAIGPYCVPVVNLEANVDQLNVNMVTCGGQATIPMVAAVSRVARVHYAEIIASIASKSAGPGTRANIDEFTETTSRAIEVVGGAAKGKAIIVLNPAEPPLMMRDTVYVLSDEASQDDIEASINEMAEAVQAYVPGYRLKQRVQFEVIPQDKPVNLPGVGQFSGLKTAVWLEVEGAAHYLPAYAGNLDVMTSSALATAEKMAQSLARKAGEAA

SEQ ID NO: 167 - protein, 312 aa, Pseudomonas putida
MSKKLKVAIIGPGNIGTDLMIKVMRNAEHLEMGAMVGIDPASDGLARAQRMGVATTHEGVEGLINLPEFADIDFVFDATSASAHVRNDALLRRAKPGIRLIDLTPAAIGPYCVPVVNLEEHLAKLNVNMVTCGGQATIPMVAAVSRVAKVHYAEIVASIASKSAGPGTRANIDEFTETTSKAIEVIGGAAKGKAIIIMNPAEPPLIMRDTVFVLSEAVDQAQVEASIEEMASAVQAYVPGYRLKQKVQFDMIPASAPLHIPGLGTFSGLKTSIYLEVEGAAHYLPAYAGNLDIMTSAALATAERMAQSLLNA

SEQ ID NO: 168 - protein, 311 aa, Pseudomonas sp. 34 E 7
MKKLKVAIVGSGNIGTDLMIKIMRNAKYLEMGAMVGIDPNSDGLARAARLGVAITHEGVEGLTKLPIFPEIDFVFDATSAGAHVKNDAFLRSIKPGIRLIDLTPAAIGPYCIPVVNLEQNLNALNVNMVTCGGQATIPMVAAVSRVAKVHYAEIVASIASKSAGPGTRANIDEFTETTSQAIEAVGGAARGKAIIVMNPAEPPLMMRDTVFVLSEAADKAQIEASVEEMVAAVQAYVPGYRLKQKVQFDEISEQAPLNIPGLGKFHGLKISIFLEVEGAAHYLPSYAGNLDIMTSAALATAERMAHSMTSV

SEQ ID NO: 169 - protein, 306 aa, Pseudomonas fluorescens
MNKIKCALIGPGNIGTDLLYKLQRSTVLEPVWMVGVDPTSEGLRRAAAMGLKTTSDGVDGLLPHIATDGILIAFDATSAYVHAENSRKLNELGVMMIDLTPAAIGPFCVPPVNLLKHVGQGEMNVNMVTCGGQATIPMVAAVSRVQPVTYGEIVATTASKSIGPGTRANIDEFTRTTGSAIEIVGGAKKGKAIIIINPAEPPMIMRDTVHCLTETEPDRERITASVQKMVKEVQKYVPGYKLVNGPVFDGKRISLFLEVEGLGDYLPKYAGNLDIMTAAAVRTAEMFAEEISSGKLKLGPTIETQK

SEQ ID NO: 170 - protein, 304 aa, Paraburkholderia xenovorans (strain LB400)
MTKKIKCALIGPGNIGTDLLAKLQRSPVLEPIWMVGIDPESDGLKRAREMGIKTTADGVDGLIPHMQADGVQIVFDATSAYVHADNSRKVNALGALMIDLTPAAIGPFCVPTVNLKEHVGKGEMNVNMVTCGGQATIPMVAAVSRVQPVAYGEIVATVSSKSAGPGTRKNIDEFTRTTAGAVEKVGGAKKGKAIIILNPAEPPLIMRDTVHCLLESEPDQAKITESIHAMIKEVQKYVPGYKLVNGPVFDGLRVSVYLEVEGLGDYLPKYAGNLDIMTAAAARTAEMFAEEILAGQLTLQPVHA

SEQ ID NO: 171 - protein, 464 aa, Salmonella typhimurium
MNTSELETLIRTILSEQLTTPAQTPVQPQGKGIFQSVSEAIDAAHQAFLRYQQCPLKTRSAIISAMRQELTPLLAPLAEESANETGMGNKEDKFLKNKAALDNTPGVEDLTTTALTGDGGMVLFEYSPFGVIGSVAPSTNPTETIINNSISMLAAGNSIYFSPHPGAKKVSLKLISLIEEIAFRCCGIRNLVVTVAEPTFEATQQMMAHPRIAVLAITGGPGIVAMGMKSGKKVIGAGAGNPPCIVDETADLVKAAEDIINGASFDYNLPCIAEKSLIVVESVAERLVQQMQTFGALLLSPADTDKLRAVCLPEGQANKKLVGKSPSAMLEAAGIAVPAKAPRLLIALVNADDPWVTSEQLMPMLPVVKVSDFDSALALALKVEEGLHHTAIMHSQNVSRLNLAARTLQTSIFVKNGPSYAGIGVGGEGFTTFTIATPTGEGTTSARTFARSRRCVLTNGFSIR

SEQ ID NO: 172 - protein, 469 aa, Listeria monocytogenes serovar 1/2a (strain ATCC BAA-679 / EGD-e)
MESLELEKLVKKVLLEKLAEQKGIPVKTMTKGAKSGVFDTVDEAVQAAVIAQNSYKEKSLEERRNVVKAIREALYPEIESIAARAVAETGMGNVADKILKNTLAIEKTPGVEDLYTEVATGDNGMTLYELSPYGVIGAVAPSTNPTETLICNTIGMLAAGNAVFYSPHPGAKNISLWLIEKLNTIVRESCGVDNLVVTVEKPSIQAAQEMMNHPKVPLLVITGGPGVVLQAMQSGKKVIGAGAGNPPSIVDETANIEKAAADIVDGASFDHNILCIAEKSVVAVDSIADFLMFQMEKNGALHVTNPSDIQKLEKVAVTDKGVTNKKLVGKSASEILKEAGIACDFSPRLIIVETEKTHPFATVELLMPIVPVVRVPNFEEALEVAIELEQGLHHTATMHSQNISRLNKAARDMQTSIFVKNGPSFAGLGFRGEGSTTFTIATPTGEGTTTARHFARRRRCVLTDGFSIR

SEQ ID NO: 173 - protein, 469 aa, Listeria monocytogenes serotype 4a (strain M7)
MESLELEKLVKKVLLEKLAEQKDIPVKTTVKGAKSGVFDTVDEAVQAAVIAQNSYKEKSLEERRNVVKAIREALYPEIESIAARAVAETGMGNVADKILKNTLAIEKTPGVEDLYTEVATGDNGMTLYELSPYGVIGAVAPSTNPTETLICNTIGMLAAGNAVFYSPHPGAKNISLWLIEKLNTIVRESCGVDNLVVTVEKPSIQAAQEMMNHPKVPLLVITGGPGVVLQAMQSGKKVIGAGAGNPPSIVDETANIEKAAADIVDGASFDHNILCIAEKSIVAVDSIADFLMFQMEKNGALHVTNPSDIQKLEKVAVTDKGVTNKKLVGKSASEILKEAGIVCDFSPRLIIVETEKTHPFATVELLMPIVPVVRVPNFDEALDVAIELEQGLHHTATMHSQNISRLNKAARDMQTSIFVKNGPSFAGLGFRGEGSTTFTIATPTGEGTTTARHFARRRRCVLTDGFSIR

SEQ ID NO: 174 - protein, 462 aa, Klebsiella pneumoniae subsp. pneumoniae (strain ATCC 700721 / MGH 78578)
MNTAELETLIRTILSEKLAPTPPAPQQEQGIFCDVGSAIDAAHQAFLRYQQCPLKTRSAIISALRETLAPELATLAEESATETGMGNKEDKYLKNKAALENTPGIEDLTTSALTGDGGMVLFEYSPFGVIGAVAPSTNPTETIINNSISMLAAGNSVYFSPHPGAKKVSLKLIARIEEIAYRCSGIRNLVVTVAEPTFEATQQMMSHPLIAVLAITGGPGIVAMGMKSGKKVIGAGAGNPPCIVDETADLVKAAEDIISGAAFDYNLPCIAEKSLIVVASVADRLIQQMQDFDALLLSRQEADTLRAVCLPDGAANKKLVGKSPAALLAAAGLAVPPRPPRLLIAEVEANDPWVTCEQLMPVLPIVRVADFDSALALALRVEEGLHHTAIMHSQNVSRLNLAARTLQTSIFVKNGPSYAGIGVGGEGFTTFTIATPTGEGTTSARTFARLRRCVLTNGFSIR

SEQ ID NO: 175 - protein, 488 aa, Acinetobacter sp. HBS-2
MAKEIYIAGEWRLGRGAVIQSLFPADQSVNAELSTATLEDVNEAIEKADQAWRQPSWRNSLPHERARILYKVADIIEARVDELAKLQTRDNGKPLTDTRGLVMSAAATARYVAAACETLNDELTTQRAPDFMTMSVHEPVGVVAAITPWNSPIASEVQKLAPALAAGNAVVLKPAEATSLIALELAKIFEEAGLPKGLLSVLVGRGSIIGDAIAQHPLVRKISFTGGTTTGRHLAHIAADKLITTSLELGGKSPTIVLPDADVELAAKGVAYGIFSSAGQACIAGSRLFIHSSLYDQFLTRLVEITKGLRVGHPEQAGVHLGPLVNDKHLQSVDRYVQLAKSEGGQVLIGGEALTTGDYAKGSYYLPTIITGLNNSAQTCQEEIFGPVLVVMKYDNEQDLIAQANDSCFGLAAGIWTESYRKAWRIARALEVGTVWINTYKKFSISAPFGGFKDSGIGREKGRLGILSYMQQKSIYMGLNEQPNPWCD

SEQ ID NO: 176 - protein, 468 aa, Clostridium beijerinckii
MNKDTLIPTTKDLKLKTNVENINLKNYKDNSSCFGVFENVENAINSAVHAQKILSLHYTKEQREKIITEIRKAALENKEVLATMILEETHMGRYEDKILKHELVAKYTPGTEDLTTTAWSGDNGLTVVEMSPYGVIGAITPSTNPTETVICNSIGMIAAGNAVVFNGHPGAKKCVAFAIEMINKAIISCGGPENLVTTIKNPTMESLDAIIKHPLIKLLCGTGGPGMVKTLLNSGKKAIGAGAGNPPVIVDDTADIEKAGKSIIEGCSFDNNLPCIAEKEVFVFENVADDLISNMLKNNAVIINEDQVSKLIDLVLQKNNETQEYFINKKWVGKDAKLFSDEIDVESPSNIKCIVCEVNANHPFVMTELMMPILPIVRVKDIDEAVKYTKIAEQNRKHSAYIYSKNIDNLNRFEREIDTTIFVKNAKSFAGVGYEAEGFTTFTIAGSTGEGITSARNFTRQRRCVLAG

SEQ ID NO: 177 - protein, 462 aa, Lachnoclostridium phytofermentans (strain ATCC 700394 / DSM 18823 / ISDg)
MTVNEQLVQDIIKNVVASMQLTQTNKTELGVFDDMNQAIEAAKEAQLVVKKMSMDQREKIISAIRKKTIEHAETLARMAVEETGMGNVGHKILKHQLVAEKTPGTEDITTTAWSGDRGLTLVEMGPFGVIGAITPCTNPSETIICNTIGMLAGGNTVVFNPHPAAIKTSNFAVQLINEASLSAGGPVNIACSVRKPTLDSSKIMMSHQDIPLIAATGGPGVVTAVLQSGKRGIGAGAGNPPVLVDETADIRKAAEDIINGCTFDNNLPCIAEKEVVAIDAIANELMNYMVKEQGCYAITKEQQEKLTNLVITPKGLNRNCVGKDARTLLGMIGIDVPSNIRCIIFEGEKEHPLISEELMMPILGIVRAKSFDDAVEKAVWLEHGNRHSAHIHSKNVDRITTYAKAIDTAILVKNAPSYAAIGFGGEGFCTFTIASRTGEGLTSASTFTKRRRCVMSDSLCIR

SEQ ID NO: 178 - protein, 307 aa, Comamonas testosteroni
MTQKKIKCALIGPGNIGTDLLMKLQRSPILEPVWMVGIDPESDGLKRAREMGIKTTADGVDGLLPFVKEDGIQIAFDATSAYVHAENSRKLNELGVLMIDLTPAAIGPYCVPSVNLAEKVAEKAMNVNMVTCGGQATIPMVAAVSRVQAVSYGEIVATVSSRSVGPGTRKNIDEFTRTTSGAVEKIGGAQKGKAIIVINPAEPPLIMRDTIHCLTVDTPKPAEIEASVHAMIKEVQKYVPGYKLVNGPVIDGNRVSIYMEVEGLGDYLPKYAGNLDIMTAAAARTAEMFAEEILAGRFELAEAAVAV

SEQ ID NO: 179 - protein, 468 aa, Eubacterium hallii CAG:12
MNIDVELIEKVVKKVLNDVETGSSESEYGYGIFDTMDEAIEASAKAQKEYMNHSMADRQRYVEGIREVVCTKENLEYMSKLAVEESGMGAYEYKVIKNRLAAVKSPGVEDLTTEALSGDDGLTLVEYCPFGVIGAIAPTTNPTETVICNSIAMLAGGNTVVFSPHPRSKGVSIWLIKKLNAKLEELGAPRNLIVTVKEPSIENTNIMMNHPKVRMLVATGGPGIVKAVMSTGKKAIGAGAGNPPVVVDETADIEKAAKDIVNGCSFDNNLPCIAEKEVIAVDQIADYLIFNMKNNGAYEVKDPEIIEKMVDLVTKDRKKPAVNFVGKSAQYILDKVGIKVGPEVKCIIMEAPKDHPFVQIELMMPILPIVRVPNVDEAIDFAVEVEHGNRHTAMMHSKNVDKLTKMAKEIETTIFVKNGPSYAGIGVGGMGYTTFTIAGPTGEGLTSAKSFCRKRRCVLQDGLHIRMK

SEQ ID NO: 180 - protein, 481 aa, Lactobacillus collinoides
MADQNIEAEIRRILQEELSGNASSSAAGTTTSQPDGLGNRIFTNVNDAIAAAKQAQAIYQDKPLAFRKKVVQAIKDGFGPYIEYMAKQTREETGMGTAEAKIAKLKNALYNTPGVELLDPEVETGDGGMVMYEYTPFGVIGAVGPSTNPCETVLNNSIMMMSAGNALFFGAHPGAKNITRWAVEKLNEFVYKATGLKNLLVSLDTPSIESVQEMMQHPDVAMLAVTGGPAVVHQALTSGKKAVGAGAGNPPAMVDATADIDLAAHNLFTSAKFDNEILCTSEKEIIAEDSIKDELLQKIVAKGACLVTDPKDIKHLADMTIGDNGAPDRKYVGKDATVILDAAGISYTGDPKLIMMDVDKDNPLVKTEMLMPILPIVGCPDFDAVLATAIEVEGGNHHTASIHSNNILHINKAAHRMNTSIFVANGPTFAATGVGDNGYYSGAAALTIATPTGEGTTTTKTFTRRRRFNCPQGFSLRSWEV

SEQ ID NO: 181 - protein, 477 aa, Lactobacillus reuteri
MQINDIESAVRKILAEELDNASSSSANVAATTDNGHRGIFTNVNDAIAAAKAAQEIYRDKPIAVRQQVIDAIKEGFRPYIEKMAKDIKEETGMGTVEAKIAKLNNALYNTPGPEILEPVVENGDGGMVMYERLPYGVIGAVGPSTNPSETVIANAIMMLAGGNTLYFGAHPGAKNVTRWTIEKMNDFIADATGLHNLVVSIETPTIESVQQMMKHPDIAMLAVTGGPAVVHQAMTSGKKAVGAGPGNPPAMVDATADIDLAAHNIITSASFDNDILCTAEKEVVAESSIKDELIRKMQDEGAFVVNREQADKLADMCIQENGAPDRKFVGKDATYILDQANIPYTGHPVEIICELPKEHPLVMTEMLMPILPVVSCPTFDDVLKTAVEVEKGNHHTATIHSNNLKHINNAAHRMQCSIFVVNGPSYVGTGVADNGAHSGASALTIATPTGEGTCTARTFTRRVRLNSPQGFSVRNWY

SEQ ID NO: 182 - protein, 303 aa, Mycobacterium tuberculosis
  misc_feature (44)..(47): Xaa can be any naturally occurring amino acid
  misc_feature (60)..(67): Xaa can be any naturally occurring amino acid
  misc_feature (90)..(91): Xaa can be any naturally occurring amino acid
  misc_feature (101)..(102): Xaa can be any naturally occurring amino acid
  misc_feature (114)..(115): Xaa can be any naturally occurring amino acid
MPSKAKVAIVGSGNISTDLLYKLLRSEWLEPRWMVGIDPESDGXXXXAKLGLETTHEGVXXXXXXXXKPDLVFEATSAYVHRDAAPKYAXXGIRAIDLTPXXVGPAVIPPANLXXHLDAPNVNMITCGGQATIPIVYAVSRIVEVPYAEIVASVASVSAGPGTRANIDEFTKTTARGVQTIGGAARGKAIIILNPADPPMIMRDTIFCAIPTDADREAIAASIHDVVKEVQTYVPGYRLLNEPQFDEPSINSGGQALVTTFVEVEGAGDYLPPYAGNLDIMTAAATKVGEEIAKETLVVGGAR

SEQ ID NO: 183 - protein, 303 aa, Mycobacterium tuberculosis (strain ATCC 25618 / H37Rv)
MPSKAKVAIVGSGNISTDLLYKLLRSEWLEPRWMVGIDPESDGLARAAKLGLETTHEGVDWLLAQPDKPDLVFEATSAYVHRDAAPKYAEAGIRAIDLTPAAVGPAVIPPANLREHLDAPNVNMITCGGQATIPIVYAVSRIVEVPYAEIVASVASVSAGPGTRANIDEFTKTTARGVQTIGGAARGKAIIILNPADPPMIMRDTIFCAIPTDADREAIAASIHDVVKEVQTYVPGYRLLNEPQFDEPSINSGGQALVTTFVEVEGAGDYLPPYAGNLDIMTAAATKVGEEIAKETLVVGGAR

SEQ ID NO: 184 - protein, 304 aa, Paraburkholderia xenovorans (strain LB400); identical to SEQ ID NO: 170

SEQ ID NO: 185 - protein, 533 aa, Rhodobacter capsulatus
MKDSDIEDAVARVLSGYTAPKSLETTVAKALTDLAKPGTQGCVWEAPKPADPIDDIIGGILTRELGEKNCSCCKAGSCTAPANCLSIPDDQAETLGDGIFATMDAAVEAAAEAQRQYLFCTMSARKRFIDGIREVFLNPALLDRISRLAVEQTGMGNVAHKIIKNRLAAEKTPGIEDLTTEAQSGDDGLTLVELSAYGVIGAITPTTNPTETIICNAIGMLAAGNAVVFSPHPRARGVSLLAIKLINRKLAALGAPPNLVVTVQAPSIENTTAMMAHPKVRMLVATGGPAIVKTVLSSGKKAIGAGAGNPPVVVDETADIPKAAQDIVNGCSFDNNMPCVAEKELIAVAEIADFLTAELVRNGAHRLTDPAQITALEKLVLTDKGGPQTGCVGKSALWLLDKIGIAAAPETRIILIETGRDHPFVQEELMMPILPLVRVGCVDEAIDLAVELEHGNRHTAIMHSTNVRKLTKMAKLIQTTIFVKNGPSYAGLGVGGEGYATFTIAGPTGEGLTSPRSFARRRKCVMVEALNVR

SEQ ID NO: 186 - protein, 300 aa, Rhodococcus jostii (strain RHA1)
MTKASVAIVGSGNISTDLLYKLQRSEWLEPRWMIGIDPESEGLARARKLGLETSAEGVDWLLNQPEKPDLVFEATSAYVHREAAPRYEAAGIRAVDLTPAAVGPAVVPPANLREHLGAPNVNMITCGGQATIPIVYAVSRVVDVPYAEIVASVASVSAGPGTRANIDEFTKTTSRGIETIGGAQRGKAIIILNPADPPMIMRDTIFCAIPEDADRAAITDSIHRVVADIQQYVPGYRLLNEPQFDDPSVVSGGQATVTTFVEVEGAGDFLPPYAGNLDIMTAAATKVGEEIAQKLLSVEA

SEQ ID NO: 187 - protein, 464 aa, Rhodopseudomonas palustris (strain BisB18)
MVAKAIRDHAGTAQPSGNAATSSAAVSDGVFETMDAAVEAAALAQQQYLLCSMSDRARFVQGIRDVILNQDTLEKMSRMAVEETGMGNYEHKLIKNRLAGEKTPGIEDLTTDAFSGDNGLTLVEYSPFGVIGAITPTTNPTETIVCNSIGMLAAGNSVVFSPHPRARQVSLLLVRLINQKLAALGAPENLVVTVEKPSIENTNAMMAHPKVRMLVATGGPAIVKAVLSTGKKAIGAGAGNPPVVVDETANIEKAACDIVNGCSFDNNLPCVAEKEIIAVAQIADYLIFNLKKNGAYEIKDPAVLQQLQDLVLTAKGGPQTKCVGKSAVWLLSQIGISVDASIKIILMEVPREHPFVQEELMMPILPLVRVETVDDAIDLAIEVEHDNRHTAIMHSTDVRKLTKMAKLIQTTIFVKNGPSYAGLGAGGEGYSTFTIAGPTGEGLTSAKSFARRRKCVMVEALNIR

SEQ ID NO: 188 - protein, 307 aa, Thermus thermophilus (strain HB8 / ATCC 27634 / DSM 579)
MSERVKVAILGSGNIGTDLMYKLLKNPGHMELVAVVGIDPKSEGLARARALGLEASHEGIAYILERPEIKIVFDATSAKAHVRHAKLLREAGKIAIDLTPAARGPYVVPPVNLKEHLDKDNVNLITCGGQATIPLVYAVHRVAPVLYAEMVSTVASRSAGPGTRQNIDEFTFTTARGLEAIGGAKKGKAIIILNPAEPPILMTNTVRCIPEDEGFDREAVVASVRAMEREVQAYVPGYRLKADPVFERLPTPWGERTVVSMLLEVEGAGDYLPKYAGNLDIMTASARRVGEVFAQHLLGKPVEEVVA

SEQ ID NO: 189 - protein, 340 aa, Acinetobacter sp. M-1
MSNHQIRAYAAMQAGEQVVPYQFDAGELKAHQVEVKVEYCGLCHSDLSVINNEWQSSVYPAVAGHEIIGTIIALGSEAKGLKLGQRVGIGWTAETCQACDPCIGGNQVLCTGEKKATIIGHAGGFADKVRAGWQWVIPLPDDLDPESAGPLLCGGITVLDPLLKHKIQATHHVGVIGIGGLGHIAIKLLKAWGCEITAFSSNPDKTEELKANGADQVVNSRDAQAIKGTRWKLIILSTANGTLNVKAYLNTLAPKGSLHFLGVTLEPIPVSVGAIMGGAKSVTSSPTGSPLALRQLLQFAARKNIAPQVELFPMSQLNEAIERLHSGQARYRIVLKADFD

SEQ ID NO: 190 - protein, 268 aa, Acinetobacter sp. M-1
MRIPQFGLGTFRLKDQAVIDSVKTALEVGYRAIDTAQVYENEAAVGQAIAESGVARQDLFLTTKIWVDNFAEDKFIPSLKDSLQKLRTDAVDLTLIHWPAPALGVSIPSVMQLLLEAKQQGLTKQIGISNFNIALTQQAIDSIGIEHIATNQIELSPYLQNRNLVNYLREQNIDVTSYMTLAYGKVLQDPTLIEIAAQHQATTAQVALAWALQNGFAVIPSSTKRENLISNLKAQDLTLSAEEMQLIAQLERNGREVSPEPFAPEWDK

SEQ ID NO: 191 - protein, 389 aa, Clostridium acetobutylicum (strain ATCC 824 / DSM 792 / JCM 1419 / LMG 5710 / VKM B-1787)
MLSFDYSIPTKVFFGKGKIDVIGEEIKKYGSRVLIVYGGGSIKRNGIYDRATAILKENNIAFYELSGVEPNPRITTVKKGIEICRENNVDLVLAIGGGSAIDCSKVIAAGVYYDGDTWDMVKDPSKITKVLPIASILTLSATGSEMDQIAVISNMETNEKLGVGHDDMRPKFSVLDPTYTFTVPKNQTAAGTADIMSHTFESYFSGVEGAYVQDGIAEAILRTCIKYGKIAMEKTDDYEARANLMWASSLAINGLLSLGKDRKWSCHPMEHELSAYYDITHGVGLAILTPNWMEYILNDDTLHKFVSYGINVWGIDKNKDNYEIAREAIKNTREYFNSLGIPSKLREVGIGKDKLELMAKQAVRNSGGTIGSLRPINAEDVLEIFKKSY

SEQ ID NO: 192 - protein, 390 aa, Clostridium acetobutylicum (strain ATCC 824 / DSM 792 / JCM 1419 / LMG 5710 / VKM B-1787); identical to SEQ ID NO: 161

SEQ ID NO: 193 - protein, 345 aa, Corynebacterium glutamicum
MTTAAPQEFTAAVVEKFGHEVTVKDIDLPKPGPNQALVKVLTSGICHTDLHALEGDWPVKPEPPFVPGHEGVGEVVELGPGEHDVKVGDIVGNAWLWSACGTCEYCITGRETQCNEAEYGGYTQNGSFGQYMLVDTRYAARIPDGVDYLEAAPILCAGVTVYKALKVSDTRPGQFMVISGVGGLGHIAVQYAVAMGMRVIAVDIADDKLELARKHGAEFTVNARNEDPGEAVQKFTDGGAHGVLVTAVHEAAFGQALDMARRAGTIVFNGLPPGEFPASVFNIVFKGLTIRGSLVGTRQDMAEALDFFARGLVKPTVSECSLDDVNDVLDRMRNGKIDGRVAIRY

SEQ ID NO: 194 - protein, 345 aa, Corynebacterium glutamicum (strain ATCC 13032 / DSM 20300 / JCM 1318 / LMG 3730 / NCIMB 10025)
MTTAAPQEFTAAVVEKFGHDVTVKDIDLPKPGPHQALVKVLTSGICHTDLHALEGDWPVKPEPPFVPGHEGVGEVVELGPGEHDVKVGDIVGNAWLWSACGTCEYCITGRETQCNEAEYGGYTQNGSFGQYMLVDTRYAARIPDGVDYLEAAPILCAGVTVYKALKVSETRPGQFMVISGVGGLGHIAVQYAAAMGMRVIAVDIADDKLELARKHGAEFTVNARNEDSGEAVQKYTNGGAHGVLVTAVHEAAFGQALDMARRAGTIVFNGLPPGEFPASVFNIVFKGLTIRGSLVGTRQDLAEALDFFARGLIKPTVSECSLDEVNGVLDRMRNGKIDGRVAIRF

SEQ ID NO: 195 - protein, 387 aa, Escherichia coli (strain K12)
MNNFNLHTPTRILFGKGAIAGLREQIPHDARVLITYGGGSVKKTGVLDQVLDALKGMDVLEFGGIEPNPAYETLMNAVKLVREQKVTFLLAVGGGSVLDGTKFIAAAANYPENIDPWHILQTGGKEIKSAIPMGCVLTLPATGSESNAGAVISRKTTGDKQAFHSAHVQPVFAVLDPVYTYTLPPRQVANGVVDAFVHTVEQYVTKPVDAKIQDRFAEGILLTLIEDGPKALKEPENYDVRANVMWAATQALNGLIGAGVPQDWATHMLGHELTAMHGLDHAQTLAIVLPALWNEKRDTKRAKLLQYAERVWNITEGSDDERIDAAIAATRNFFEQLGVPTHLSDYGLDGSSIPALLKKLEEHGMTQLGENHDITLDVSRRIYEAAR

SEQ ID NO: 196 - protein, 339 aa, Escherichia coli (strain K12)
MSMIKSYAAKEAGGELEVYEYDPGELRPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALAGQFDLIINTVNVSLDWQPYFEALTYGGNFHTVGAVLTPLSVPAFTLIAGDRSVSGSATGTPYELRKLMRFAARSKVAPTTELFPMSKINDAIQHVRDGKARYRVVLKADF

SEQ ID NO: 197 - protein, 336 aa, Escherichia coli (strain K12); identical to SEQ ID NO: 160

SEQ ID NO: 198 - protein, 376 aa, Propionibacterium freudenreichii
MKQFQLATSLACGPDALTALDRLGGRRVLVITDAFMASSALMDTVRGHLGSAEITVFDQVQPNPDVQAVARGLRAFLDCAPEALLALGGGSPIDTAKAVRKIALEQGQPLSAGFYVVPTTSGTGSEVSSFAVVTDPEHDAKLPMTSPDMVADVAILDPDAVRTCPPTLTADSGMDALSHAVEAYVALDHNDITDALAEKALRLISANLVASFRDGNDLAAREHQQNAATMAGIAFENSGLGIVHGLSHAIGGSFHVAHGRLNGILMPHVIGFNAGELGFGAATLSPIAERYAQLAAAIGIDAATRRGLVTGLVDFITAIRRDLDMPASLTDAGVDRAAFRAAIPQLSQTALRDFCTSGNPRPVTAHELAGLLAHAL

SEQ ID NO: 199 - protein, 348 aa, Saccharomyces cerevisiae (strain ATCC 204508 / S288c)
MSIPETQKGVIFYESHGKLEYKDIPVPKPKANELLINVKYSGVCHTDLHAWHGDWPLPVKLPLVGGHEGAGVVVGMGENVKGWKIGDYAGIKWLNGSCMACEYCELGNESNCPHADLSGYTHDGSFQQYATADAVQAAHIPQGTDLAQVAPILCAGITVYKALKSANLMAGHWVAISGAAGGLGSLAVQYAKAMGYRVLGIDGGEGKEELFRSIGGEVFIDFTKEKDIVGAVLKATDGGAHGVINVSVSEAAIEASTRYVRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 200 - protein, 348 aa, Saccharomyces cerevisiae (strain ATCC 204508 / S288c); identical to SEQ ID NO: 162

SEQ ID NO: 201 - protein, 382 aa, Saccharomyces cerevisiae (strain ATCC 204508 / S288c)
MSSVTGFYIPPISFFGEGALEETADYIKNKDYKKALIVTDPGIAAIGLSGRVQKMLEERDLNVAIYDKTQPNPNIANVTAGLKVLKEQNSEIVVSIGGGSAHDNAKAIALLATNGGEIGDYEGVNQSKKAALPLFAINTTAGTASEMTRFTIISNEEKKIKMAIIDNNVTPAVAVNDPSTMFGLPPALTAATGLDALTHCIEAYVSTASNPITDACALKGIDLINESLVAAYKDGKDKKARTDMCYAEYLAGMAFNNASLGYVHALAHQLGGFYHLPHGVCNAVLLPHVQEANMQCPKAKKRLGEIALHFGASQEDPEETIKALHVLNRTMNIPRNLKELGVKTEDFEILAEHAMHDACHLTNPVQFTKEQVVAIIKKAYEY

SEQ ID NO: 202 - protein, 360 aa, Saccharomyces cerevisiae (strain ATCC 204508 / S288c)
MSYPEKFEGIAIQSHEDWKNPKKTKYDPKPFYDHDIDIKIEACGVCGSDIHCAAGHWGNMKMPLVVGHEIVGKVVKLGPKSNSGLKVGQRVGVGAQVFSCLECDRCKNDNEPYCTKFVTTYSQPYEDGYVSQGGYANYVRVHEHFVVPIPENIPSHLAAPLLCGGLTVYSPLVRNGCGPGKKVGIVGLGGIGSMGTLISKAMGAETYVISRSSRKREDAMKMGADHYIATLEEGDWGEKYFDTFDLIVVCASSLTDIDFNIMPKAMKVGGRIVSISIPEQHEMLSLKPYGLKAVSISYSALGSIKELNQLLKLVSEKDIKIWVETLPVGEAGVHEAFERMEKGDVRYRFTLVGYDKEFSD

SEQ ID NO: 203 - protein, 370 aa, Salmonella typhimurium
MNTFSLQTRLYSGQGSLAVLKRFTNKHIWIICDGFLAHSPLLDTLRNALPADNRISVFSEITPDPTIHTVVQGIAQMQALQPQVVIGFGGGSAMDAAKAIVWFSQQSGINIETCVAIPTTSGTGSEVTSACVISDPDKGIKYPLFNNALYPDMAILDPELVVSVPPQITANTGMDVLTHALEAWVSPRASDFTDALAEKAAKLVFQYLPTAVEKGDCVATRGKMHNASTLAGMAFSQAGLGLNHAIAHQLGGQFHLPHGLANALLLTTVIRFNAGVPRAAKRYARLAKACGFCPAEANDIAAINALIQQIELLKQRCVLPSLAVALKEGRSDFSARIPAMVQAALADVTLRTNPRPANAEAIRELLEELL

SEQ ID NO: 204 - protein, 347 aa, Sulfurisphaera tokodaii (strain DSM 16993 / JCM 10545 / NBRC 100140 / 7)
MRAMRLVEIGKPLKLEDIPIPKPKGSQVLIKIEAAGVCHSDVHMRQGRFGNLRIVEDLGVKLPVTLGHEIAGRIEEVGDEVVGYSKGDLVAVNPWEGEGNCYYCRIGEEHLCDSPRWLGINYDGAYAEYVLVPHYKYLYKLRRLSAVEAAPLTCSGVTTYRAVRKASLDPSKTLVVIGAGGGLGTMAIQIAKAVSGATIIGVDVREEALEAAKRAGADYVINASSQDPVSEIRRITQGKGADAVIDLNNSEKTLSIYPYVLAKQGKYVMVGLFGADLKYHAPLITLNEVQFIGSLVGNQSDFLGIMSLAEAGKVKPMVTKTMKLEEANEAIDNLENFKAVGRQVLVP

SEQ ID NO: 205 - protein, 336 aa, Synechocystis sp. (strain PCC 6803 / Kazusa)
MIKAYAALEANGKLQPFEYDPGALGANEVEIEVQYCGVCHSDLSMINNEWGISNYPLVPGHEVVGTVAAMGEGVNHVEVGDLVGLGWHSGYCMTCHSCLSGYHNLCATAESTIVGHYGGFGDRVRAKGVSVVKLPKGIDLASAGPLFCGGITVFSPMVELSLKPTAKVAVIGIGGLGHLAVQFLRAWGCEVTAFTSSARKQTEVLELGAHHILDSTNPEAIASAEGKFDYIISTVNLKLDWNLYISTLAPQGHFHFVGVVLEPLDLNLFPLLMGQRSVSASPVGSPATIATMLDFAVRHDIKPVVEQFSFDQINEAIAHLESGKAHYRVVLSHSKN

SEQ ID NO: 206 - protein, 337 aa, Zymomonas mobilis subsp. mobilis (strain ATCC 31821 / ZM4 / CP4)
MKAAVITKDHTIEVKDTKLRPLKYGEALLEMEYCGVCHTDLHVKNGDFGDETGRITGHEGIGIVKQVGEGVTSLKVGDRASVAWFFKGCGHCEYCVSGNETLCRNVENAGYTVDGAMAEECIVVADYSVKVPDGLDPAVASSITCAGVTTYKAVKVSQIQPGQWLAIYGLGGLGNLALQYAKNVFNAKVIAIDVNDEQLAFAKELGADMVINPKNEDAAKIIQEKVGGAHATVVTAVAKSAFNSAVEAIRAGGRVVAVGLPPEKMDLSIPRLVLDGIEVLGSLVGTREDLKEAFQFAAEGKVKPKVTKRKVEEINQIFDEMEHGKFTGRMVVDFTHH

SEQ ID NO: 207 - protein, 461 aa, Corynebacterium glutamicum
MSDTPTSALITTVNRSFDGFDLEEVAADLGVRLTYLPDEELEVSKVLAADLLAEGPALIIGVGNTFFDAQVAAALGVPVLLLVDKQGKHVALARTQVNNAGAVVAAAFTAEQEPMPDKLRKAVRNHSNLEPVMSAELFENWLLKRARAEHSHIVLPEGDDDRILMAAHQLLDQDICDITILGDPVKIKERATELGLHLNTAYLVNPLTDPRLEEFAEQFAELRKSKSVTIDEAREIMKDISYFGTMMVHNGDADGMVSGAANTTAHTIKPSFQIIKTVPEASVVSSIFLMVLRGRLWAFGDCAVNPNPTAEQLGEIAVVSAKTAAQFGIDPRVAILSYSTGNSGGGSDVDRAIDALAEARRLNPELCVDGPLQFDAAVDPGVARKKMPDSDVAGQANVFIFPDLEAGNIGYKTAQRTGHALAVGPILQGLNKPVNDLSRGATVPDIVNTVAITAIQAGGRS

SEQ ID NO: 208 - protein, 397 aa, Corynebacterium glutamicum (strain ATCC 13032 / DSM 20300 / JCM 1318 / LMG 3730 / NCIMB 10025)
MALALVLNSGSSSIKFQLVNPENSAIDEPYVSGLVEQIGEPNGRIVLKIEGEKYTLETPIADHSEGLNLAFDLMDQHNCGPSQLEITAVGHRVVHGGILFSAPELITDEIVEMIRDLIPLAPLHNPANVDGIDVARKILPDVPHVAVFDTGFFHSLPPAAALYAINKDVAAEHGIRRYGFHGTSHEFVSKRVVEILEKPTEDINTITFHLGNGASMAAVQGGRAVDTSMGMTPLAGLVMGTRSGDIDPGIVFHLSRTAGMSIDEIDNLLNKKSGVKGLSGVNDFRELREMIDNNDQDAWSAYNIYIHQLRRYLGSYMVALGRVDTIVFTAGVGENAQFVREDALAGLEMYGIEIDPERNALPNDGPRLISTDASKVKVFVIPTNEELAIARYAVKFA

SEQ ID NO: 209 - protein, 398 aa, Saccharomyces cerevisiae (strain ATCC 204508 / S288c)
MSQNVYIVSTARTPIGSFQGSLSSKTAVELGAVALKGALAKVPELDASKDFDEIIFGNVLSANLGQAPARQVALAAGLSNHIVASTVNKVCASAMKAIILGAQSIKCGNADVVVAGGCESMTNAPYYMPAARAGAKFGQTVLVDGVERDGLNDAYDGLAMGVHAEKCARDWDITREQQDNFAIESYQKSQKSQKEGKFDNEIVPVTIKGFRGKPDTQVTKDEEPARLHVEKLRSARTVFQKENGTVTAANASPINDGAAAVILVSEKVLKEKNLKPLAIIKGWGEAAHQPADFTWAPSLAVPKALKHAGIEDINSVDYFEFNEAFSVVGLVNTKILKLDPSKVNVYGGAVALGHPLGCSGARVVVTLLSILQQEGGKIGVAAICNGGGGASSIVIEKI

SEQ ID NO: 210 - protein, 392 aa, Clostridium acetobutylicum (strain ATCC 824 / DSM 792 / JCM 1419 / LMG 5710 / VKM B-1787)
MKEVVIASAVRTAIGSYGKSLKDVPAVDLGATAIKEAVKKAGIKPEDVNEVILGNVLQAGLGQNPARQASFKAGLPVEIPAMTINKVCGSGLRTVSLAAQIIKAGDADVIIAGGMENMSRAPYLANNARWGYRMGNAKFVDEMITDGLWDAFNDYHMGITAENIAERWNISREEQDEFALASQKKAEEAIKSGQFKDEIVPVVIKGRKGETVVDTDEHPRFGSTIEGLAKLKPAFKKDGTVTAGNASGLNDCAAVLVIMSAEKAKELGVKPLAKIVSYGSAGVDPAIMGYGPFYATKAAIEKAGWTVDELDLIESNEAFAAQSLAVAKDLKFDMNKVNVNGGAIALGHPIGASGARILVTLVHAMQKRDAKKGLATLCIGGGQGTAILLEKC

SEQ ID NO: 211 - protein, 394 aa, Escherichia coli (strain K12)
MKNCVIVSAVRTAIGSFNGSLASTSAIDLGATVIKAAIERAKIDSQHVDEVIMGNVLQAGLGQNPARQALLKSGLAETVCGFTVNKVCGSGLKSVALAAQAIQAGQAQSIVAGGMENMSLAPYLLDAKARSGYRLGDGQVYDVILRDGLMCATHGYHMGITAENVAKEYGITREMQDELALHSQRKAAAAIESGAFTAEIVPVNVVTRKKTFVFSQDEFPKANSTAEALGALRPAFDKAGTVTAGNASGINDGAAALVIMEESAALAAGLTPLARIKSYASGGVPPALMGMGPVPATQKALQLAGLQLADIDLIEANEAFAAQFLAVGKNLGFDSEKVNVNGGAIALGHPIGASGARILVTLLHAMQARDKTLGLATLCIGGGQGIAMVIERLN

SEQ ID NO: 212 - protein, 391 aa, Cupriavidus necator (strain ATCC 17699 / H16 / DSM 428 / Stanier 337)
MAEAYIVAAVRTAGGRKGGKLSGWHPADLAAQVLDALVERTGADPALVEDVIMGCVSQVGEQAGNVARNAILASRLPESVPGTSVDRQCGSSQQALHFAAQAVMSGAMDIVIAAGVESMTRVPMGLSSQLPAKNGFGVPKSPGIEARYPGVQFSQFTGAEMIARKYDLSREQLDAYALQSHQRAIAATKSGRFTAEILPVEVRTADGANGEMHTTDEGVRYDATLESIGSVKLIAEGGRVTAASASQICDGAAGLMVVNEAGLKKLGVKPLARVHAMTVIGHDPVVMLEAPLPATEVALKKAGLRIGDIDLFEVNEAFAPVPLAWLKATGADPARLNVHGGAIALGHPLGGSGAKLMTTLVHALHTHGKRYGLQTMCEGGGLANVTIVERL

SEQ ID NO: 213 - protein, 395 aa, Metallosphaera sedula (strain ATCC 51363 / DSM 5348 / JCM 9185 / NBRC 15509 / TH2)
MPDVYIVSAVRTPIGRFGGSLKSVKPQMLGAIAIKEALRRANTDPSRVELTIMGNVLRSGHGQDLARQAALLAGIPWEVDGYCVDMVCSSGMMGVTNAAQMIKSGDADVVVAGGMESMSQSMLAVNSEVRWGVKFLSGKSLNFIDTMLVDGLTDPFNLKLMGQEADMVARERDISRRELDEVAFESHRRAHQAWEKGLFKSEVIPVNLDEGKLERDEGIRPDTTMEKLSSLKPAFTENGYHTAGNSSQISDGAVAMVLMSEKAVKEFGVDPVAKILGYSWVGIESWRFTEAPLYSVRKLLTRLNMNITQFDYFENNEAFAVNNVLFHRYLGVPYDQLNVFGGAIALGHPIGASGARIMVTLLNVLSKMNATRGIASICHGVGGSTAIALELLRPL

SEQ ID NO: 214 - protein, 403 aa, Arabidopsis thaliana
MAHTSESVNPRDVCIVGVARTPMGGFLGSLSSLPATKLGSLAIAAALKRANVDPALVQEVVFGNVLSANLGQAPARQAALGAGIPNSVICTTVNKVCASGMKAVMIAAQSIQLGINDVVVAGGMESMSNTPKYLAEARKGSRFGHDSLVDGMLKDGLWDVYNDCGMGSCAELCAEKFQITREQQDDYAVQSFERGIAAQEAGAFTWEIVPVEVSGGRGRPSTIVDKDEGLGKFDAAKLRKLRPSFKENGGTVTAGNASSISDGAAALVLVSGEKALQLGLLVLAKIKGYGDAAQEPEFFTTAPALAIPKAIAHAGLESSQVDYYEINEAFAVVALANQKLLGIAPEKVNVNGGAVSLGHPLGCSGARILITLLGILKKRNGKYGVGGVCNGGGGASALVLELL

SEQ ID NO: 215 - protein, 216 aa, Escherichia coli (strain K12)
MDAKQRIARRVAQELRDGDIVNLGIGLPTMVANYLPEGIHITLQSENGFLGLGPVTTAHPDLVNAGGQPCGVLPGAAMFDSAMSFALIRGGHIDACVLGGLQVDEEANLANWVVPGKMVPGMGGAMDLVTGSRKVIIAMEHCAKDGSAKILRRCTMPLTAQHAVHMLVTELAVFRFIDGKMWLTEIADGCDLATVRAKTEARFEVAADLNTQRGDL

SEQ ID NO: 216 - protein, 220 aa, Escherichia coli (strain K12)
MKTKLMTLQDATGFFRDGMTIMVGGFMGIGTPSRLVEALLESGVRDLTLIANDTAFVDTGIGPLIVNGRVRKVIASHIGTNPETGRRMISGEMDVVLVPQGTLIEQIRCGGAGLGGFLTPTGVGTVVEEGKQTLTLDGKTWLLERPLRADLALIRAHRCDTLGNLTYQLSARNFNPLIALAADITLVEPDELVETGELQPDHIVTPGAVIDHIIVSQESK

SEQ ID NO: 217 - protein, 508 aa, Paraburkholderia unamae
MDVAKAVEQIFDGATIALTGSGGGLLEADAVLAALEQRFLATGHPRDLTIVHALGIGDGKGSGLGRFAHQGMVRRVIGGHWSWSPAMQQLAKEEAFEAYSLPAGAISTLLREIGAGRPGLITHVGLRTFVDPRVEGGKLNARATEDLVELVELDGREYLRYKPFKVDFAIVRGSSADAHGNVTLRREPVDLDTYAVALAAHNSGGRVIAQVKACMPEGESVPARLVRIPGVLVDAVVEAPSQVQCTVADYDPVLSGETRDTQCAVEPEVPTGIRYLIAARAARELGEGCSANFGFGIPGGIPGILAQQGRLGTFWGSVEQGIHNGEMLDGPMFGTARNAHAILSGVDQFDFYSGGGIDVTFLGMGEMDGEGNINVSKLGPTVVGPGGFIDITQGARKIVFCGAFEAKGLEVEQHGERVTITRPGSVPKLVQRVQQITFSGAQARIAGQEVLYVTERAVFRLERDGVRLIEVTPGIDIERDVIARMGFRPLVDAALLARRGALSQERAA

SEQ ID NO: 218 - protein, 531 aa, Escherichia coli O157:H7
MKPVKPPRINGRVPVLSAQEAVNYIPDEATLCVLGAGGGILEATTLITALADKYKQTQTPRNLSIISPTGLGDRADRGISPLAQEGLVKWALCGHWGQSPRISDLAEQNKIIAYNYPQGVLTQTLRAAAAHQPGIISDIGIGTFVDPRQQGGKLNEVTKEDLIKLVEFDNKEYLYYKAIAPDIAFIRATTCDSEGYATFEDEVMYLDALVIAQAVHNNGGIVMMQVQKMVKKATLHPKSVRIPGYLVDIVVVDPDQSQLYGGAPVNRFISGDFTLDDSTKLSLPLNQRKLVARRALFEMRKGAVGNVGVGIADGIGLVAREEGCADDFILTVETGPIGGITSQGIAFGANVNTRAILDMTSQFDFYHGGGLDVCYLSFAEVDQHGNVGVHKFNGKIMGTGGFIDISATSKKIIFCGTLTAGSLKTEIADGKLNIVQEGRVKKFIRELPEITFSGKIALERGLDVRYITERAVFTLKEDGLHLIEIAPGVDLQKDILDKMDFTPVISPELKLMDERLFIDAAMGFVLPEAAH

SEQ ID NO: 219 - protein, 218 aa, Clostridium acetobutylicum (strain ATCC 824 / DSM 792 / JCM 1419 / LMG 5710 / VKM B-1787)
MNSKIIRFENLRSFFKDGMTIMIGGFLNCGTPTKLIDFLVNLNIKNLTIISNDTCYPNTGIGKLISNNQVKKLIASYIGSNPDTGKKLFNNELEVELSPQGTLVERIRAGGSGLGGVLTKTGLGTLIEKGKKKISINGTEYLLELPLTADVALIKGSIVDEAGNTFYKGTTKNFNPYMAMAAKTVIVEAENLVSCEKLEKEKAMTPGVLINYIVKEPA

SEQ ID NO: 220 - protein, 221 aa, Clostridium acetobutylicum (strain ATCC 824 / DSM 792 / JCM 1419 / LMG 5710 / VKM B-1787)
MINDKNLAKEIIAKRVARELKNGQLVNLGVGLPTMVADYIPKNFKITFQSENGIVGMGASPKINEADKDVVNAGGDYTTVLPDGTFFDSSVSFSLIRGGHVDVTVLGALQVDEKGNIANWIVPGKMLSGMGGAMDLVNGAKKVIIAMRHTNKGQPKILKKCTLPLTAKSQANLIVTELGVIEVINDGLLLTEINKNTTIDEIRSLTAADLLISNELRPMAV

SEQ ID NO: 221 - protein, 217 aa, Clostridium saccharobutylicum DSM 13864
MNKIVKLEDLKHVFKDGMTIMVGGFLDCGTPENIIDMLVDLNIKNLTIISNDTAFPDKGIGKLIVNGQVSKIIASHIGTNPETGKKMNNGEIEVELSPQGTLIERIRAAGSGLGGVLTPTGLGTIVEEGKRKVTIGGKEYLLELPLCADVSIVKGSVVDEFGNICYRATTKNFNPYMAMAGKIVIVEAENLVKCEQLKRENIMTPGVLVNYIVKEAA

SEQ ID NO: 222 - protein, 221 aa, Clostridium saccharobutylicum DSM 13864
MIQDKTIAKKIIAKRVAKELKEGQLVNLGIGLPSLVANYVPNEMNITFQSENGIVGMGKIAERDKEDEDIINAGGQCTTLLPHGAFLDSSMSFSLIRGGHVDVAVLGALEVDEKGNLANWIVPNKIVPGMGGAMDLAIGAKRIIVAMQHTGKGKPKILKKCNLPLTAKSQVDLIVTELGVIKVISDGLLLKEINKDTTIDEIKSLTEADLIIPPDIKTMDV

SEQ ID NO: 223 - protein, 240 aa, Escherichia coli
MRKITTAEALAAQIQDGATIAISGNGGGMVEADHIMAAIEARFLQTGHPRDLTLIHSLGIGDRDSKGTNRFAHAEMLKRIIAGHFTWSPKMQALVKNNTIEAYCFPGGVIQALLREIGAGRPGLFTHVGLGSFVDPRNGGGKSNECTTDDLVELIEIDGETKLRYRPFKVDYAILRGTYADPRGNVSLEEEAIDMDSYSMALAAHNSGGKVFVQVRDVLEAGTIEPRRVKATRNSGRWHR

SEQ ID NO: 224 - protein, 339 aa, Escherichia coli
MRGTYADPRGNVSLEEEAIDMDSYSMALAAHNSGGKVFVQVRDVLEAGAIEPRRVKLPGILVDGIVEHREQPQTYLGGYDLTISGQHRRLSSNDAIELVSHPVRRLIARRAARELVAGASTNFGFGIPGGIPGVALREGVPYQSLWLSVEQGVHNGMMLDDALFGCARNADAIIPSLDQFEFYSGGGIDITFLGMGEMDQYGNVNVSHLNGNLIGPGGFLEIAQNARKVVFCGTFDAKGSKIDVTPDGLHIAQSGQIPKLVTQVEKITFSAAYAQQSGQEVLYITERAVFQLTAEGVELIEIAPSVEIERDILPYMAFRPIIKHPRLMESSLFTPMEDA

SEQ ID NO: 225 - protein, 244 aa, Clostridium acetobutylicum (strain ATCC 824 / DSM 792 / JCM 1419 / LMG 5710 / VKM B-1787)
MLKDEVIKQISTPLTSPAFPRGPYKFHNREYFNIVYRTDMDALRKVVPEPLEIDEPLVRFEIMAMHDTSGLGCYTESGQAIPVSFNGVKGDYLHMMYLDNEPAIAVGRELSAYPKKLGYPKLFVDSDTLVGTLDYGKLRVATATMGYKHKALDANEAKDQICRPNYMLKIIPNYDGSPRICELINAKITDVTVHEAWTGPTRLQLFDHAMAPLNDLPVKEIVSSSHILADIILPRAEVIYDYLK

SEQ ID NO: 226 - protein, 246 aa, Clostridium beijerinckii (strain ATCC 51743 / NCIMB 8052)
MLESEVSKQITTPLAAPAFPRGPYRFHNREYLNIIYRTDLDALRKIVPEPLELDRAYVRFEMMAMPDTTGLGSYTECGQAIPVKYNGVKGDYLHMMYLDNEPAIAVGRESSAYPKKLGYPKLFVDSDTLVGTLKYGTLPVATATMGYKHEPLDLKEAYAQIARPNFMLKIIQGYDGKPRICELICAENTDITIHGAWTGSARLQLFSHALAPLADLPVLEIVSASHILTDLTLGTPKVVHDYLSVK

SEQ ID NO: 227 - protein, 326 aa, Patiria pectinifera
MDWFVFFVNSILFIVPVLLAVALLTLVERKVLGYMQLRKGPNIVGPFGLLQPIADGFKLLIKETLKPSNASPYLFFFSPVLFLGIALVLWSVIPVKYSVVSVNLSLMLIIGLSSLSVYSLLGSGWSSNSNYSFLGAVRAVAQTVSYEISLGLILLGVVLFAGGFNVEVIESSQSWSWLMFSCFPLFAIWFVSTLAETNRAPFDLTEGESEIVSGYNVEYAGGPFAMFFIAEYANIIFINLLSVLLFLGGSSPMGEFFPVNVLVVSLKAGVLVLLFLWVRASYPRFRYDQLMYLTWKKYLPLSLSFLVFFVVLLGVLDSLPPSSCFL

SEQ ID NO: 228 - protein, 247 aa, Ralstonia solanacearum (strain GMI1000)
MDIDTVRKTAFAMPLTSPAYPPGPYRFINREFFIITYRTDPARLRAMVPEPLEVPEPLVSYEFIRMADSTGFGDYTESGQVIPVTFEGKPGTYTLAMYLDDHPPLAGGREMWGFPKKLATPRLQTSKDTLLGTLDYGPVRVATGTMGYKHKELDLAAQQQRLARPNFLLKIIPHVDGRTARICELSRNTMEDIVMKGAWTGPASLELAHHALAPVADLPVLEIVEARHLIADLTLGMGEVVFDYLAK

SEQ ID NO: 229 - protein, 252 aa, Paraburkholderia xenovorans (strain LB400)
MDVKSVLSNAFAMPITSPAFPMGPYRFINREFLIITYRTDPDKLRAVVPEPLEIGEPLVHYEFIRMPDSTGFGDYTESGQVIPVSYKGVAGGYTLAMYLDDHPPIAGGRELWGFPKKLANPVLAVHTDTLVGTLDYGPVRIATGTMGYKHRQLDLAQQKKRLETPNFLLKVIPHVDGTPRICELVRYYLQDIDLKGAWTGPAALELAPHALAPVAALPVLEVVEARHLIADLTLGLGEVVFDYLGQPQANAR

SEQ ID NO: 230 - protein, 246 aa, Paenibacillus polymyxa
MNQKDVLSLQSMPAASGSYGRPPCRFINREFFIITYESDPAAIRQAVPEPLQPDGSNTVSYEWIKMPDSSGLGSYEESGIVIPCTFQGEPCNFVAQMYLDNAPAILGGREIWGFPKKWAKPRLVVEDTETLTGTLHYNNVLVAMGTTPFKYNVLDEKETAKAIAKTQVNLKLIPDVDGTPKIAQLVAYNLENITVKGAWSGPARLSLIPHVNAPVADLPVKTYVGGKHFIANLTLPYGRVLYDYLQ

SEQ ID NO: 231 - protein, 132 aa, Escherichia coli (strain K12)
MSTTHNVPQGDLVLRTLAMPADTNANGDIFGGWLMSQMDIGGAILAKEIAHGRVVTVRVEGMTFLRPVAVGDVVCCYARCVQKGTTSVSINIEVWVKKVASEPIGQRYKATEALFKYVAVDPEGKPRALPVE

SEQ ID NO: 232 - protein, 139 aa, Acinetobacter baylyi (strain ATCC 33305 / BD413 / ADP1)
MLDAHISPEGTLSLQTIAMPADTNWSGDVFGGWIVSQMDLAGAIHAERFSKGRCATISINQMTFLVPVKVGDVISCYTKILKVGNTSIQMQIEVWDSHDSSRPPKRVTEGVFTFVAVDVKGNKRTIAEDLKQQFLQHAS

SEQ ID NO: 233 - protein, 418 aa, Saccharomyces cerevisiae (strain ATCC 204508 / S288c)
MSATLFNNIELLPPDALFGIKQRYGQDQRATKVDLGIGAYRDDNGKPWVLPSVKAAEKLIHNDSSYNHEYLGITGLPSLTSNAAKIIFGTQSDAFQEDRVISVQSLSGTGALHISAKFFSKFFPDKLVYLSKPTWANHMAIFENQGLKTATYPYWANETKSLDLNGFLNAIQKAPEGSIFVLHSCAHNPTGLDPTSEQWVQIVDAIASKNHIALFDTAYQGFATGDLDKDAYAVRLGVEKLSTVSPVFVCQSFAKNAGMYGERVGCFHLALTKQAQNKTIKPAVTSQLAKIIRSEVSNPPAYGAKIVAKLLETPELTEQWHKDMVTMSSRITKMRHALRDHLVKLGTPGNWDHIVNQCGMFSFTGLTPQMVKRLEETHAVYLVASGRASIAGLNQGNVEYVAKAIDEVVRFYTIEAKL

SEQ ID NO: 234 - protein, 136 aa, Corynebacterium glutamicum (strain R)
MLRTILGSKIHRATVTQADLDYVGSVTIDADLVHAAGLIEGEKVAIVDITNGARLETYVIVGDAGTGNICINGAAAHLINPGDLVIIMSYLQATDAEAKAYEPKIVHVDADNRIVALGNDLAEALPGSGLLTSRSI

SEQ ID NO: 235 - protein, 376 aa, Saccharomyces cerevisiae (strain ATCC 204508 / S288c)
MTLAPLDASKVKITTTQHASKPKPNSELVFGKSFTDHMLTAEWTAEKGWGTPEIKPYQNLSLDPSAVVFHYAFELFEGMKAYRTVDNKITMFRPDMNMKRMNKSAQRICLPTFDPEELITLIGKLIQQDKCLVPEGKGYSLYIRPTLIGTTAGLGVSTPDRALLYVICCPVGPYYKTGFKAVRLEATDYATRAWPGGCGDKKLGANYAPCVLPQLQAASRGYQQNLWLFGPNNNITEVGTMNAFFVFKDSKTGKKELVTAPLDGTILEGVTRDSILNLAKERLEPSEWTISERYFTIGEVTERSKNGELLEAFGSGTAAIVSPIKEIGWKGEQINIPLLPGEQTGPLAKEVAQWINGIQYGETEHGNWSRVVTDLN

SEQ ID NO: 236 - protein, 475 aa, Lachancea kluyveri
MPSYSVAELYYPDEPTEPKISTSSYPGPKAKQELEKLSNVFDTRAAYLLADYYKSRGNYIVDQDGNVLLDVYAQISSIALGYNNPEILKVAKSDAMSVALANRPALACFPSNDYGQLLEDGLLKAAPQGQDKIWTALSGSDANETAFKACFMYQAAKKRNGRSFSTEELESVMDNQLPGTSEMVICSFEKGFHGRLFGSLSTTRSKPIHKLDIPAFNWPKAPFPDLKYPLEENKEANKAEESSCIEKFSQIVQEWQGKIAAVIIEPIQSEGGDNHASSDFFQKLREITIENGILMIVDEVQTGVGATGKMWAHEHWNLSNPPDLVTFSKKFQAAGFYYHDPKLQPDQPFRQFNTWCGDPSKALIAKVIYEEIVKHDLVTRTAEVGNYLFNRLEKLFEGKNYIQNLRGKGQGTYIAFDFGTSSERDSFLSRLRCNGANVAGCGDSAVRLRPSLTFEEKHADVLVSIFDKTLRQLYG

SEQ ID NO: 237 - protein, 540 aa, Escherichia coli (strain K12)
MRVNNGLTPQELEAYGISDVHDIVYNPSYDLLYQEELDPSLTGYERGVLTNLGAVAVDTGIFTGRSPKDKYIVRDDTTRDTFWWADKGKGKNDNKPLSPETWQHLKGLVTRQLSGKRLFVVDAFCGANPDTRLSVRFITEVAWQAHFVKNMFIRPSDEELAGFKPDFIVMNGAKCTNPQWKEQGLNSENFVAFNLTERMQLIGGTWYGGEMKKGMFSMMNYLLPLKGIASMHCSANVGEKGDVAVFFGLSGTGKTTLSTDPKRRLIGDDEHGWDDDGVFNFEGGCYAKTIKLSKEAEPEIYNAIRRDALLENVTVREDGTIDFDDGSKTENTRVSYPIYHIDNIVKPVSKAGHATKVIFLTADAFGVLPPVSRLTADQTQYHFLSGFTAKLAGTERGITEPTPTFSACFGAAFLSLHPTQYAEVLVKRMQAAGAQAYLVNTGWNGTGKRISIKDTRAIIDAILNGSLDNAETFTLPMFNLAIPTELPGVDTKILDPRNTYASPEQWQEKAETLAKLFIDNFDKYTDTPAGAALVAAGPKL

SEQ ID NO: 238 - protein, 332 aa, Saccharomyces cerevisiae (strain ATCC 204508 / S288c)
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGDSHSSIFDASAGIQLSPKFVKLVSWYDNEYGYSTRVVDLVEHVAKA

SEQ ID NO: 239 - protein, 356 aa, Kluyveromyces lactis
MPDMTNESSSKPAQINIGINGFGRIGRLVLRAALTHPEVKVRLINNPSTTPEYAAYLFKYDSTHGKYRGEVEFDDERIIIQNDHVSAHIPLSHFREPERIPWASYNVDYVIDSTGVFKEVDTASRHKGVKKVIITAPSKTAPMYVYGVNHVKYNPLTDHVVSNASCTTNCLAPLVKALDDEFGIEEALMTTIHATTASQKTVDGTSSGGKDWRGGRSCQGNIIPSSTGAAKAVGKILPELNGKITGMSIRVPTINISLVDLTFRTAKKTSYDDIMKALEQRSRSDMKGVLGVTKDAVVSSDFTSDSRSSIVDAKAGIELNDHFFKVLSWYDNEYGYSSRVVDLSIFMAQKDFEAGV

SEQ ID NO: 240 - protein, 500 aa, Saccharomyces cerevisiae (strain ATCC 204508 / S288c)
MSRLERLTSLNVVAGSDLRRTSIIGTIGPKTNNPETLVALRKAGLNIVRMNFSHGSYEYHKSVIDNARKSEELYPGRPLAIALDTKGPEIRTGTTTNDVDYPIPPNHEMIFTTDDKYAKACDDKIMYVDYKNITKVISAGRIIYVDDGVLSFQVLEVVDDKTLKVKALNAGKICSHKGVNLPGTDVDLPALSEKDKEDLRFGVKNGVHMVFASFIRTANDVLTIREVLGEQGKDVKIIVKIENQQGVNNFDEILKVTDGVMVARGDLGIEIPAPEVLAVQKKLIAKSNLAGKPVICATQMLESMTYNPRPTRAEVSDVGNAILDGADCVMLSGETAKGNYPINAVTTMAETAVIAEQAIAYLPNYDDMRNCTPKPTSTTETVAASAVAAVFEQKAKAIIVLSTSGTTPRLVSKYRPNCPIILVTRCPRAARFSHLYRGVFPFVFEKEPVSDWTDDVEARINFGIEKAKEFGILKKGDTYVSIQGFKAGAGHSNTLQVSTV

SEQ ID NO: 241 - protein, 422 aa, Clostridium acetobutylicum (strain ATCC 824 / DSM 792 / JCM 1419 / LMG 5710 / VKM B-1787)
QKKWGETPINERARIMRKAADILDDNAEYIAKILSNEIAKDLKSSLSEVKRTADFIRFTANEGTHMEGEAINSDNFPGSKKDKLSLVERVPLGIVLAISPFNYPVNLSGSKVAPALIAGNSVVLKPSTTGAISALHLAEIFNAAGLPAGVLNTVTGKGSEIGDYLITHEEVNFINFTGSSAVGKHISKIAGMIPMVLELGGKDAAIVLEDANLETTAKSIVSGAYGYSGQRCTAVKRVLVMDKVADELVELVTKKVKELKVGNPFDDVTITPLIDNKAADYVQTLIDDAIEKGATLIVGNKRKENLMYPTLFDNVTADMRIAWEEPFGPVLPIIRVKSMDEAIELANRSEYGLQSAVFTENMHDAFYIANKLDVGTVQVNNKPERGPDHFPFLGTKSSGMGTQGIRYSIEAMTRHKSIVLNL

SEQ ID NO: 242 - protein, 528 aa, Artificial Sequence
  Enzyme No. 6
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPEDAIYLNESTSTTAQMWQRLNMRNPGSYYLCAAGGLGFALPAAIGVQLAEPERQVIAVIGDGSANYSISALWTAAQYNVPTIFVIMNNGTYGTLRWFAGVLEAENVPGLDVPGIDFRALAKGYGVQALKADNLEQLKGSLQEALSAKGPVLIEVSTVSPVK

SEQ ID NO: 243 - protein, 528 aa, Artificial Sequence
  Enzyme No. 7
MASVHGTTYELLRRQGIDIVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYRQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLDMRNPGSYYFCAAGGLGFALPAAIGVQLAEPGRQVIAVIGDGSANYSISALWTAAQYNIPTIFVIMNNGTYGLLRWSAGVLGAENVPGLDVPGIDFRALAKGYGVQALKADNLEQLKGSLQEALSAKGPVLIEVSTVSPVK

SEQ ID NO: 244 - protein, 528 aa, Artificial Sequence
  Enzyme No. 8
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYRQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGGLRWFAGVLEAENVPGLDVPGIDFRALAKGYGVQALKADNLEQLKGSLQEALSAKGPVLIEVSTVSPVK

SEQ ID NO: 245 - protein, 528 aa, Artificial Sequence
  Enzyme No. 9
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGTLRWFAGVLEAENVPGLDVPGIDFRALAKGYGVQALKADNLEQLKGSLQEALSAKGPVLIEVSTVSPVK

SEQ ID NO: 246 - protein, 528 aa, Artificial Sequence
  Enzyme No. 10
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYACAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 247 - protein, 528 aa, Artificial Sequence
  Enzyme No. 11
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGLLRWFAGVLEAENVPGLDVPGIDFRALAKGYGVQALKADNLEQLKGSLQEALSAKGPVLIEVSTVSPVK

SEQ ID NO: 248 - protein, 528 aa, Artificial Sequence
  Enzyme No. 12
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYRQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 249 - protein, 528 aa, Artificial Sequence
  Enzyme No. 13
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYRQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGTLRWFAGVLEAENVPGLDVPGIDFRALAKGYGVQALKADNLEQLKGSLQEALSAKGPVLIEVSTVSPVK

SEQ ID NO: 250 - protein, 528 aa, Artificial Sequence
  Enzyme No. 14
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 251 - protein, 528 aa, Artificial Sequence
  Enzyme No. 15
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGLLRWFAGVLEAENVPGLDVPGIDFRALAKGYGVQALKADNLEQLKGSLQEALSAKGPVLIEVSTVSPVK

SEQ ID NO: 252 - protein, 528 aa, Artificial Sequence
  Enzyme No. 16
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPEDAIYLNESTSTTAQMWQRLNMRNPGSYYLCAAGGLGFALPAAIGVQLAEPERQVIAVIGDGSANYSISALWTAAQYNVPTIFVIMNNGTYGLLRWFAGVLEAENVPGLDVPGIDFRALAKGYGVQALKADNLEQLKGSLQEALSAKGPVLIEVSTVSPVK

SEQ ID NO: 253 - protein, 528 aa, Artificial Sequence
  Enzyme No. 17
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPEDAIYLNESTSTTAQMWQRLNMRNPGSYYLCAAGGLGFALPAAIGVQLAEPERQVIAVIGDGSANYSISALWTAAQYNVPTIFVIMNNGTYGGLRWFAGVLEAENVPGLDVPGIDFRALAKGYGVQALKADNLEQLKGSLQEALSAKGPVLIEVSTVSPVK

SEQ ID NO: 254 - protein, 528 aa, Artificial Sequence
  Enzyme No. 18
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPEDAIYLNESTSTTAQMWQRLNMRNPGSYYLCAAGGLGFALPAAIGVQLAEPERQVIAVIGDGSANYSISALWTAAQYNVPTIFVIMNNGTYGTLRWSAGVLEAENVPGLDVPGIDFRALAKGYGVQALKADNLEQLKGSLQEALSAKGPVLIEVSTVSPVK

SEQ ID NO: 255 - protein, 528 aa, Artificial Sequence
  Enzyme No. 19
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPEDAIYLNESTSTTAQMWQRLNMRNPGSYYLCAAGGLGFALPAAIGVQLAEPGRQVIAVIGDGSANYSISALWTAAQYNVPTIFVIMNNGTYGTLRWSAGVLGAENVPGLDVPGIDFRALAKGYGVQALKADNLEQLKGSLQEALSAKGPVLIEVSTVSPVK

SEQ ID NO: 256 - protein, 528 aa, Artificial Sequence
  Enzyme No. 20
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPEDAIYLNESTSTTAQMWQRLNMRNPGSYYLCAAGGLGFALPAAIGVQLAEPGRQVIAVIGDGSANYSISALWTAAQYNIPTIFVIMNNGTYGTLRWSAGVLGAENVPGLDVPGIDFRALAKGYGVQALKADNLEQLKGSLQEALSAKGPVLIEVSTVSPVK

SEQ ID NO: 257 - protein, 528 aa, Artificial Sequence
  Enzyme No. 21
MASVHGTTYELLRRQGIDIVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLDMRNPGSYYFCAAGGLGFALPAAIGVQLAEPGRQVIAVIGDGSANYSISALWTAAQYNIPTIFVIMNNGTYGLLRWSAGVLGAENVPGLDVPGIDFRALAKGYGVQALKADNLEQLKGSLQEALSAKGPVLIEVSTVSPVK

SEQ ID NO: 258 - protein, 528 aa, Artificial Sequence
  Enzyme No. 22
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYRQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYNCAAGGLGFALPAAIGVQLAEPERQVIAVIGDGSANYSISALWTAAQYNIPTIFVIMNNGTYGLLRWFAGVLEAENVPGLDVPGIDFRALAKGYGVQALKADNLEQLKGSLQEALSAKGPVLIEVSTVSPVK

SEQ ID NO: 259 - protein, 528 aa, Artificial Sequence
  Enzyme No. 23
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYRQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYWCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 260 - protein, 528 aa, Artificial Sequence
  Enzyme No. 24
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYRQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYRCAAGGVGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 261 - protein, 528 aa, Artificial Sequence
  Enzyme No. 25
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYRQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYWCAAGGLGFALPAAIGVQLAEPERQVIAVIGDGSANYSISALWTAAQYNIPTIFVIMNNGTYGNLRWFAGVLEAENVPGLDVPGIDFRALAKGYGVQALKADNLEQLKGSLQEALSAKGPVLIEVSTVSPVK

SEQ ID NO: 262 - protein, 528 aa, Artificial Sequence
  Enzyme No. 26
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVTSSVRLNDQDLDILVKALNSASNPVIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGTLRWFAGVLEAENVPGLDVPGIDFRALAKGYGVQALKADNLEQLKGSLQEALSAKGPVLIEVSTVSPVK

SEQ ID NO: 263 - protein, 528 aa, Artificial Sequence
  Enzyme No. 27
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYACAAGGLGFALPAAIGVQLAEPERQVIAVIGDGSANYSISALWTAAQYNIPTIFVIMNNGTYGTLRWFAGVLEAENVPGLDVPGIDFRALAKGYGVQALKADNLEQLKGSLQEALSAKGPVLIEVSTVSPVK

SEQ ID NO: 264 - protein, 528 aa, Artificial Sequence
  Enzyme No. 28
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYLCAAGGLGFALPAAIGVQLAEPERQVIAVIGDGSANYSISALWTAAQYNIPTIFVIMNNGTYGTLRWFAGVLEAENVPGLDVPGIDFRALAKGYGVQALKADNLEQLKGSLQEALSAKGPVLIEVSTVSPVK

SEQ ID NO: 265 - protein, 528 aa, Artificial Sequence
  Enzyme No. 29
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPEDAIYLNESTSTTAQMWQRLNMRNPGSYYRCAAGGVGFALPAAIGVQLAEPERQVIAVIGDGSANYSISALWTAAQYNVPTIFVIMNNGTYGALRWFAGVLEAENVPGLDVPGIDFRALAKGYGVQALKADNLEQLKGSLQEALSAKGPVLIEVSTVSPVK

SEQ ID NO: 266 - protein, 528 aa, Artificial Sequence
  Enzyme No. 30
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPEDAIYLNESTSTTAQMWQRLNMRNPGSYYRCAAGGVGFALPAAIGVQLAEPERQVIAVIGDGSANYSISALWTAAQYNVPTIFVIMNNGTYGGLRWFAGVLEAENVPGLDVPGIDFRALAKGYGVQALKADNLEQLKGSLQEALSAKGPVLIEVSTVSPVK

SEQ ID NO: 267 - protein, 528 aa, Artificial Sequence
  Enzyme No. 31
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPEDAIYLNESTSTTAQMWQRLNMRNPGSYYWCAAGGSGFALPAAIGVQLAEPERQVIAVIGDGSANYSISALWTAAQYNVPTIFVIMNNGTYGNLRWFAGVLEAENVPGLDVPGIDFRALAKGYGVQALKADNLEQLKGSLQEALSAKGPVLIEVSTVSPVK

SEQ ID NO: 268 - protein, 528 aa, Artificial Sequence
  Enzyme No. 32
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYRQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYWCAAGGLGFALPAAIGVQLAEPERQVIAVIGDGSANYSISALWTAAQYNIPTIFVIMNNGTYGLLRWFAGVLEAENVPGLDVPGIDFRALAKGYGVQALKADNLEQLKGSLQEALSAKGPVLIEVSTVSPVK

SEQ ID NO: 269 - protein, 528 aa, Artificial Sequence
  Enzyme No. 33
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYRQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYRCAAGGLGFALPAAIGVQLAEPERQVIAVIGDGSANYSISALWTAAQYNIPTIFVIMNNGTYGLLRWFAGVLEAENVPGLDVPGIDFRALAKGYGVQALKADNLEQLKGSLQEALSAKGPVLIEVSTVSPVK

SEQ ID NO: 270 - protein, 528 aa, Artificial Sequence
  Enzyme No. 34
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYWCAAGGLGFALPAAIGVQLAEPERQVIAVIGDGSANYSISALWTAAQYNIPTIFVIMNNGTYGTLRWFAGVLEAENVPGLDVPGIDFRALAKGYGVQALKADNLEQLKGSLQEALSAKGPVLIEVSTVSPVK

SEQ ID NO: 271 - protein, 528 aa, Artificial Sequence
  Enzyme No. 35
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYRCAAGGLGFALPAAIGVQLAEPERQVIAVIGDGSANYSISALWTAAQYNIPTIFVIMNNGTYGTLRWFAGVLEAENVPGLDVPGIDFRALAKGYGVQALKADNLEQLKGSLQEALSAKGPVLIEVSTVSPVK

SEQ ID NO: 272 - protein, 528 aa, Artificial Sequence
  36
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPEDAIYLNESTSTTAQMWQRLNMRNPGSYYRCAAGGVGFALPAAIGVQLAEPERQVIAVIGDGSANYSISALWTAAQYNVPTIFVIMNNGTYGTLRWFAGVLEAENVPGLDVPGIDFRALAKGYGVQALKADNLEQLKGSLQEALSAKGPVLIEVSTVSPVK

SEQ ID NO: 273 - protein, 528 aa, Artificial Sequence
  Enzyme No. 37
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEARLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHRYDPGQYLKPGTRLISVTCDPLEAARAPMGDAIVADIGAMASALANLVEESSRQLPTAAPEPAKVDQDAGRLHPETVFDTLNDMAPEDAIYLNESTSTTAQMWQRLNMRNPGSYYWCAAGGSGFALPAAIGVQLAEPERQVIAVIGDGSANYSISALWTAAQYNVPTIFVIMNNGTYGTLRWFAGVLEAENVPGLDVPGIDFRALAKGYGVQALKADNLEQLKGSLQEALSAKGPVLIEVSTVSPVK

SEQ ID NO: 274 - protein, 528 aa, Artificial Sequence
  amino acid sequence of the enzymes able to catalyze the decarboxylation of oxaloacetate into malonic semi-aldehyde
  VARIANT (19)..(19): Xaa in position 19 is selected from the group consisting of threonine and isoleucine
  VARIANT (109)..(109): Xaa in position 109 is selected from the group consisting of leucine, lysine, arginine and valine
  VARIANT (110)..(110): Xaa in position 110 is selected from the group consisting of leucine and lysine
  VARIANT (180)..(180): Xaa in position 180 is selected from the group consisting of serine and threonine
  VARIANT (204)..(204): Xaa in position 204 is selected from the group consisting of alanine and valine
  VARIANT (281)..(281): Xaa in position 281 is selected from the group consisting of histidine and arginine
  VARIANT (282)..(282): Xaa in position 282 is selected from the group consisting of glutamine and arginine
  VARIANT (369)..(369): Xaa in position 369 is selected from the group consisting of asparagine and aspartic acid
  VARIANT (377)..(377): Xaa in position 377 is selected from the group consisting of threonine and serine
  VARIANT (388)..(388): Xaa in position 388 is selected from the group consisting of asparagine and aspartic acid
  VARIANT (397)..(397): Xaa in position 397 is selected from the group consisting of phenylalanine, asparagine, alanine, isoleucine, valine, leucine, tryptophan and arginine
  VARIANT (398)..(398): Xaa in position 398 is selected from the group consisting of cysteine and arginine
  VARIANT (403)..(403): Xaa in position 403 is selected from the group consisting of leucine, asparagine, alanine, valine and serine
  VARIANT (419)..(419): Xaa in position 419 is selected from the group consisting of glutamic acid and glycine
  VARIANT (446)..(446): Xaa in position 446 is selected from the group consisting of isoleucine and valine
  VARIANT (460)..(460): Xaa in position 460 is selected from the group consisting of alanine, leucine, threonine, glycine and asparagine
  VARIANT (464)..(464): Xaa in position 464 is selected from the group consisting of phenylalanine and serine
  VARIANT (469)..(469): Xaa in position 469 is selected from the group consisting of glutamic acid and glycine
MASVHGTTYELLRRQGIDXVFGNPGSNELPFLKDFPEDFRYILALQEACVVGIADGYAQASRKPAFINLHSAAGTGNAMGALSNAWNSHSPLIVTAGQQTRAMIGVEAXXTNVDAANLPRPLVKWSYEPASAAEVPHAMSRAIHMASMAPQGPVYLSVPYDDWDKDADPQSHHLFDRHVXSSVRLNDQDLDILVKALNSASNPXIVLGPDVDAANANADCVMLAERLKAPVWVAPSAPRCPFPTRHPCFRGLMPAGIAAISQLLEGHDVVLVIGAPVFRYXXYDPGQYLKPGTRLISVTCDPLEAARAPMGDAIVADIGAMASALANLVEESSRQLPTAAPEPAKVDQDAGRLHPETVFDTLNDMAPEXAIYLNESXSTTAQMWQRLXMRNPGSYYXXAAGGXGFALPAAIGVQLAEPXRQVIAVIGDGSANYSISALWTAAQYNXPTIFVIMNNGTYGXLRWXAGVLXAENVPGLDVPGIDFRALAKGYGVQALKADNLEQLKGSLQEALSAKGPVLIEVSTVSPVK

SEQ ID NO: 275 - protein, 540 aa, Tribolium castaneum
MPATGEDQDLVQDLIEEPATFSDAVLSSDEELFHQKCPKPAPIYSPVSKPVSFESLPNRRLHEEFLRSSVDVLLQEAVFEGTNRKNRVLQWREPEELRRLMDFGVRSAPSTHEELLEVLKKVVTYSVKTGHPYFVNQLFSAVDPYGLVAQWATDALNPSVYTYEVSPVFVLMEEVVLREMRAIVGFEGGKGDGIFCPGGSIANGYAISCARYRFMPDIKKKGLHSLPRLVLFTSEDAHYSIKKLASFQGIGTDNVYLIRTDARGRMDVSHLVEEIERSLREGAAPFMVSATAGTTVIGAFDPIEKIADVCQKYKLWLHVDAAWGGGALVSAKHRHLLKGIERADSVTWNPHKLLTAPQQCSTLLLRHEGVLAEAHSTNAAYLFQKDKFYDTKYDTGDKHIQCGRRADVLKFWFMWKAKGTSGLEKHVDKVFENARFFTDCIKNREGFEMVIAEPEYTNICFWYVPKSLRGRKDEADYKDKLHKVAPRIKERMMKEGSMMVTYQAQKGHPNFFRIVFQNSGLDKADMVHLVEEIERLGSDL

SEQ ID NO: 276 - protein, 608 aa, Arabidopsis thaliana
MTATTTLKSFNYLSLINHRLNHNSYAILSSPLLPRSHPASTSFSNSGFRFFQSNHLFSSQSGSLMEVFKAAFSEASNSCDRIAIKADGKSYSYGQLTSSALRISKLFLKDDTTNGGQETKKYEGFGSLKGARIGIVAKPSAEFVAGVLGTWFSGGVAVPLALSYPEAELLHVMNDSDISLLLSTEDHSETMKTIAAKSGARFHLIPPVVNSTSETVACNQFQDDSFEAEGKFLDDPALIVYTSGTTGKPKGVVHTHNSINSQVRMLTEAWEYTSADHFLHCLPLHHVHGLFNALFAPLYARSLVEFLPKFSVSGIWRRWRESYPVNDEKTNDSITVFTGVPTMYTRLIQGYEAMDKEMQDSSAFAARKLRLMMSGSSALPRPVMHQWESITGHRLLERYGMTEFVMAMSNPLRGARNAGTVGKPLPGVEAKIKEDENDANGVGEICVKSPSLFKEYWNLPEVTKESFTEDGYFKTGDAGRVDEDGYYVILGRNSADIMKVGGYKLSALEIESTLLEHPTVAECCVLGLTDNDYGEAVTAIIIAESAAKKRREDESKPVITLEELCGWAKDKLAPYKLPTRLLIWESLPRNAMGKVNKKELKKSLENQE

SEQ ID NO: 277 - protein, 576 aa, Homo sapiens
MLPHVVLTFRRLGCALASCRLAPARHRGSGLLHTAPVARSDRSAPVFTRALAFGDRIALVDQHGRHTYRELYSRSLRLSQEICRLCGCVGGDLREERVSFLCANDASYVVAQWASWMSGGVAVPLYRKHPAAQLEYVICDSQSSVVLASQEYLELLSPVVRKLGVPLLPLTPAIYTGAVEEPAEVPVPEQGWRNKGAMIIYTSGTTGRPKGVLSTHQNIRAVVTGLVHKWAWTKDDVILHVLPLHHVHGVVNALLCPLWVGATCVMMPEFSPQQVWEKFLSSETPRINVFMAVPTIYTKLMEYYDRHFTQPHAQDFLRAVCEEKIRLMVSGSAALPLPVLEKWKNITGHTLLERYGMTEIGMALSGPLTTAVRLPGSVGTPLPGVQVRIVSENPQREACSYTIHAEGDERGTKVTPGFEEKEGELLVRGPSVFREYWNKPEETKSAFTLDGWFKTGDTVVFKDGQYWIRGRTSVDIIKTGGYKVSALEVEWHLLAHPSITDVAVIGVPDMTWGQRVTAVVTLREGHSLSHRELKEWARNVLAPYAVPSELVLVEEIPRNQMGKIDKKALIRHFHPS

SEQ ID NO: 278 - protein, 1220 aa, Chloroflexus aurantiacus
MSGTGRLAGKIALITGGAGNIGSELTRRFLAEGATVIISGRNRAKLTALAERMQAEAGVPAKRIDLEVMDGSDPVAVRAGIEAIVARHGQIDILVNNAGSAGAQRRLAEIPLTEAELGPGAEETLHASIANLLGMGWHLMRIAAPHMPVGSAVINVSTIFSRAEYYGRIPYVTPKAALNALSQLAARELGARGIRVNTIFPGPIESDRIRTVFQRMDQLKGRPEGDTAHHFLNTMRLCRANDQGALERRFPSVGDVADAAVFLASAESAALSGETIEVTHGMELPACSETSLLARTDLRTIDASGRTTLICAGDQIEEVMALTGMLRTCGSEVIIGFRSAAALAQFEQAVNESRRLAGADFTPPIALPLDPRDPATIDAVFDWGAGENTGGIHAAVILPATSHEPAPCVIEVDDERVLNFLADEITGTIVIASRLARYWQSQRLTPGARARGPRVIFLSNGADQNGNVYGRIQSAAIGQLIRVWRHEAELDYQRASAAGDHVLPPVWANQIVRFANRSLEGLEFACAWTAQLLHSQRHINEITLNIPANISATTGARSASVGWAESLIGLHLGKVALITGGSAGIGGQIGRLLALSGARVMLAARDRHKLEQMQAMIQSELAEVGYTDVEDRVHIAPGCDVSSEAQLADLVERTLSAFGTVDYLINNAGIAGVEEMVIDMPVEGWRHTLFANLISNYSLMRKLAPLMKKQGSGYILNVSSYFGGEKDAAIPYPNRADYAVSKAGQRAMAEVFARFLGPEIQINAIAPGPVEGDRLRGTGERPGLFARRARLILENKRLNELHAALIAAARTDERSMHELVELLLPNDVAALEQNPAAPTALRELARRFRSEGDPAASSSSALLNRSIAAKLLARLHNGGYVLPADIFANLPNPPDPFFTRAQIDREARKVRDGIMGMLYLQRMPTEFDVAMATVYYLADRNVSGETFHPSGGLRYERTPTGGELFGLPSPERLAELVGSTVYLIGEHLTEHLNLLARAYLERYGARQVVMIVETETGAETMRRLLHDHVEAGRLMTIVAGDQIEAAIDQAITRYGRPGPVVCTPFRPLPTVPLVGRKDSDWSTVLSEAEFAELCEHQLTHHFRVARKIALSDGASLALVTPETTATSTTEQFALANFIKTTLHAFTATIGVESERTAQRILINQVDLTRRARAEEPRDPHERQQELERFIEAVLLVTAPLPPEADTRYAGRIHRGRAITV

SEQ ID NO: 279 - protein, 493 aa, Homo sapiens
MRGFGPGLTARRLLPLRLPPRPPGPRLASGQAAGALERAMDELLRRAVPPTPAYELREKTPAPAEGQCADFVSFYGGLAETAQRAELLGRLARGFGVDHGQVAEQSAGVLHLRQQQREAAVLLQAEDRLRYALVPRYRGLFHHISKLDGGVRFLVQLRADLLEAQALKLVEGPDVREMNGVLKGMLSEWFSSGFLNLERVTWHSPCEVLQKISEAEAVHPVKNWMDMKRRVGPYRRCYFFSHCSTPGEPLVVLHVALTGDISSNIQAIVKEHPPSETEEKNKITAAIFYSISLTQQGLQGVELGTFLIKRVVKELQREFPHLGVFSSLSPIPGFTKWLLGLLNSQTKEHGRNELFTDSECKEISEITGGPINETLKLLLSSSEWVQSEKLVRALQTPLMRLCAWYLYGEKHRGYALNPVANFHLQNGAVLWRINWMADVSLRGITGSCGLMANYRYFLEETGPNSTSYLGSKIIKASEQVLSLVAQFQKNSKL

SEQ ID NO: 280 - protein, 548 aa, Lactococcus lactis
MYTVGDYLLDRLHELGIEEIFGVPGDYNLQFLDQIISRKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENPTSNTSDQEILNKIQESLKNAKKPIVITGHEIISFGLENTVTQFISKTKLPITTLNFGKSSVDETLPSFLGIYNGKLSEPNLKEFVESADFILMLGVKLTDSSTGAFTHHLNENKMISLNIDEGKIFNESIQNFDFESLISSLLDLSGIEYKGKYIDKKQEDFVPSNALLSQDRLWQAVENLTQSNETIVAEQGTSFFGASSIFLKPKSHFIGQPLWGSIGYTFPAALGSQIADKESRHLLFIGDGSLQLTVQELGLAIREKINPICFIINNDGYTVEREIHGPNQSYNDIPMWNYSKLPESFGATEERVVSKIVRTENEFVSVMKEAQADPNRMYWIELVLAKEDAPKVLKKMGKLFAEQNKS

SEQ ID NO: 281 - protein, 547 aa, Lactococcus lactis
MYTVGDYLLDRLHELGIEEIFGVPGDYNLQFLDQIISREDMKWIGNANELNASYMADGYARTKKAAAFLTTFGVGELSAINGLAGSYAENLPVVEIVGSPTSKVQNDGKFVHHTLADGDFKHFMKMHEPVTAARTLLTAENATYEIDRVLSQLLKERKPVYINLPVDVAAAKAEKPALSLEKESSTTNTTEQVILSKIEESLKNAQKPVVIAGHEVISFGLEKTVTQFVSETKLPITTLNFGKSAVDESLPSFLGIYNGKLSEISLKNFVESADFILMLGVKLTDSSTGAFTHHLDENKMISLNIDEGIIFNKVVEDFDFRAVVSSLSELKGIEYEGQYIDKQYEEFIPSSAPLSQDRLWQAVESLTQSNETIVAEQGTSFFGASTIFLKSNSRFIGQPLWGSIGYTFPAALGSQIADKESRHLLFIGDGSLQLTVQELGLSIREKLNPICFIINNDGYTVEREIHGPTQSYNDIPMWNYSKLPETFGATEDRVVSKIVRTENEFVSVMKEAQADVNRMYWIELVLEKEDAPKLLKKMGKLFAEQNK

SEQ ID NO: 282 - protein, 635 aa, Saccharomyces cerevisiae
MAPVTIEKFVNQEERHLVSNRSATIPFGEYIFKRLLSIDTKSVFGVPGDFNLSLLEYLYSPSVESAGLRWVGTCNELNAAYAADGYSRYSNKIGCLITTYGVGELSALNGIAGSFAENVKVLHIVGVAKSIDSRSSNFSDRNLHHLVPQLHDSNFKGPNHKVYHDMVKDRVACSVAYLEDIETACDQVDNVIRDIYKYSKPGYIFVPADFADMSVTCDNLVNVPRISQQDCIVYPSENQLSDIINKITSWIYSSKTPAILGDVLTDRYGVSNFLNKLICKTGIWNFSTVMGKSVIDESNPTYMGQYNGKEGLKQVYEHFELCDLVLHFGVDINEINNGHYTFTYKPNAKIIQFHPNYIRLVDTRQGNEQMFKGINFAPILKELYKRIDVSKLSLQYDSNVTQYTNETMRLEDPTNGQSSIITQVHLQKTMPKFLNPGDVVVCETGSFQFSVRDFAFPSQLKYISQGFFLSIGMALPAALGVGIAMQDHSNAHINGGNVKEDYKPRLILFEGDGAAQMTIQELSTILKCNIPLEVIIWNNNGYTIERAIMGPTRSYNDVMSWKWTKLFEAFGDFDGKYTNSTLIQCPSKLALKLEELKNSNKRSGIELLEVKLGELDFPEQLKCMVEAAALKRNKK

SEQ ID NO: 283 - protein, 491 aa, Saccharomyces cerevisiae
MKLSTKLCWCGIKGRLRPQKQQQLHNTNLQMTELKKQKTAEQKTRPQNVGIKGIQIYIPTQCVNQSELEKFDGVSQGKYTIGLGQTNMSFVNDREDIYSMSLTVLSKLIKSYNIDTNKIGRLEVGTETLIDKSKSVKSVLMQLFGENTDVEGIDTLNACYGGTNALFNSLNWIESNAWDGRDAIVVCGDIAIYDKGAARPTGGAGTVAMWIGPDAPIVFDSVRASYMEHAYDFYKPDFTSEYPYVDGHFSLTCYVKALDQVYKSYSKKAISKGLVSDPAGSDALNVLKYFDYNVFHVPTCKLVTKSYGRLLYNDFRANPQLFPEVDAELATRDYDESLTDKNIEKTFVNVAKPFHKERVAQSLIVPTNTGNMYTASVYAAFASLLNYVGSDDLQGKRVGLFSYGSGLAASLYSCKIVGDVQHIIKELDITNKLAKRITETPKDYEAAIELRENAHLKKNFKPQGSIEHLQSGVYYLTNIDDKFRRSYDVKK

SEQ ID NO: 284 - protein, 299 aa, Bacillus subtilis
MPYPKKVTIKEVGPRDGLQNEPVWIATEDKITWINQLSRTGLSYIEITSFVHPKWIPALRDAIDVAKGIDREKGVTYAALVPNQRGLENALEGGINEACVFMSASETHNRKNINKSTSESLHILKQVNNDAQKANLTTRAYLSTVFGCPYEKDVPIEQVIRLSEALFEFGISELSLGDTIGAANPAQVETVLEALLARFPANQIALHFHDTRGTALANMVTALQMGITVFDGSAGGLGGCPYAPGSSGNAATEDIVYMLEQMDIKTNVKLEKLLSAAKWIEEKMGKPLPSRNLQVFKSS

SEQ ID NO: 285 - protein, 329 aa, Streptomyces sp.
MTDVRFRIIGTGAYVPERIVSNDEVGAPAGVDDDWITRKTGIRQRRWAADDQATSDLATAAGRAALKAAGITPEQLTVIAVATSTPDRPQPPTAAYVQHHLGATGTAAFDVNAVCSGTVFALSSVAGTLVYRGGYALVIGADLYSRILNPADRKTVVLFGDGAGAMVLGPTSTGTGPIVRRVALHTFGGLTDLIRVPAGGSRQPLDTDGLDAGLQYFAMDGREVRRFVTEHLPQLIKGFLHEAGVDAADISHFVPHQANGVMLDEVFGELHLPRATMHRTVETYGNTGAASIPITMDAAVRAGSFRPGELVLLAGFGGGMAASFALIEW

What is claimed is:

1. A recombinant microorganism capable of co-producing 3-hydroxypropionic acid (3-HP), and/or derivatives thereof, and acetyl-CoA from a feedstock comprising one or more carbon sources, wherein the recombinant microorganism comprises:
   (a) at least one exogenous nucleic acid molecule encoding an enzyme that is able to catalyze the decarboxylation of oxaloacetate into malonate semialdehyde;
   (b) at least one endogenous and/or exogenous nucleic acid molecule encoding a 3-hydroxypropionic acid dehydrogenase that catalyzes the production of 3-HP from malonate semialdehyde from (a); and
   (c) at least one endogenous and/or exogenous nucleic acid molecule encoding a
      (i) malonate semialdehyde dehydrogenase that catalyzes the production of acetyl-CoA from malonate semialdehyde from (a), and/or
      (ii) malonyl-CoA reductase and/or 2-keto acid decarboxylase that catalyzes the conversion of malonate semialdehyde from (a) into malonyl-CoA, and malonyl-CoA decarboxylase that catalyzes the production of acetyl-CoA from malonyl-CoA;
   wherein at least a portion of excess NAD(P)H generated in the production of acetyl-CoA is utilized as a source of reducing equivalents in the production of 3-HP and/or 3-HP derivatives;
   wherein the derivatives of 3-HP are selected from the group consisting of: acrylic acid, 1-propanol, propene, and polypropylene.

2. The recombinant microorganism of claim 1, wherein the recombinant microorganism is capable of producing 1-propanol, wherein the recombinant microorganism comprises one or more of the following:
   (a) at least one endogenous and/or exogenous nucleic acid molecule encoding a propionyl-CoA synthase that catalyzes the conversion of 3-HP into propionyl-CoA;
   (b) at least one endogenous and/or exogenous nucleic acid molecule encoding a 3-hydroxypropionyl-CoA synthetase/CoA transferase, 3-hydroxypropionyl-CoA dehydratase, and acrylyl-CoA reductase that catalyzes the conversion of 3-HP into propionyl-CoA;
   (c) at least one endogenous and/or exogenous nucleic acid molecule encoding an alcohol/aldehyde dehydrogenase that catalyzes the conversion of propionyl-CoA from (a) or (b) into 1-propanol, or an aldehyde dehydrogenase (acetylating) and alcohol dehydrogenase that catalyzes together the production of 1-propanol from propionyl-CoA.

3. The recombinant microorganism of claim 1, wherein the recombinant microorganism is capable of further producing acetone, 2-propanol, propene, and/or polypropylene from the acetyl-CoA.

4. The recombinant microorganism of claim 1, wherein the recombinant microorganism co-produces 3-HP, and/or derivatives thereof, and acetyl-CoA in an aerobic, microaerobic or anaerobic production process.

5. The recombinant microorganism of claim 1, wherein the microorganism is selected from a bacterium, a fungus, or a yeast.

6. The recombinant microorganism of claim 1, wherein the endogenous and/or exogenous nucleic acid molecule encoding a 3-hydroxypropionic acid dehydrogenase encodes an amino acid sequence comprising MCR-Nterm.Cau (SEQ ID NO: 105), ADH.Ae (SEQ ID NO: 106), MMSB.Bce (SEQ ID NO: 107), YDFG-0.Ec (SEQ ID NO: 108), YMR226C (YDF1) (SEQ ID NO: 109), or HPD1 (SEQ ID NO: 110).

7. The recombinant microorganism of claim 1, wherein the endogenous and/or exogenous nucleic acid molecule encoding a malonate semialdehyde dehydrogenase encodes an amino acid sequence comprising MSD.Pa (SEQ ID NO: 111), MSD.Cal (SEQ ID NO: 112), iolA (SEQ ID NO: 113), iolA (SEQ ID NO: 114), iolA (SEQ ID NO: 115), mmsA (SEQ ID NO: 116), dddC (SEQ ID NO: 117), or iolA (SEQ ID NO: 118).

8. The recombinant microorganism of claim 1, wherein the endogenous and/or exogenous nucleic acid molecule encoding a malonyl-CoA reductase and/or 2-keto acid decarboxylase encodes an amino acid sequence comprising mcr (SEQ ID NO: 278), matA, MLYCD (SEQ ID NO: 279), kivD (SEQ ID NO: 280), kdcA (SEQ ID NO: 281), ARO10 (SEQ ID NO: 282).

9. The recombinant microorganism of claim 1, wherein the at least one exogenous nucleic acid molecule encoding an enzyme that is able to catalyze the decarboxylation of oxaloacetate into malonate semialdehyde encodes an amino acid sequence comprising (SEQ ID NO: 1) or (SEQ ID NO: 274).

10. A method of co-producing 3-HP, and/or derivatives thereof, and acetyl-CoA by contacting the recombinant microorganism of claim 1 with a fermentable carbon source under conditions and for a sufficient period of time to produce 3-HP, or derivatives, and acetyl-CoA.

11. The method of claim 10, wherein the carbon source is selected from sugars, glycerol, alcohols, organic acids, alkanes, fatty acids, lignocellulose, proteins, carbon dioxide, and carbon monoxide.

12. The method of claim 11, wherein the recombinant microorganism co-produces 3-HP, and/or derivatives thereof, and acetyl-CoA in an aerobic, microanaerobic or anaerobic production process.

13. The recombinant microorganism of claim 1, wherein the recombinant microorganism produces acetone and comprises one or more of the following:
(a) at least one endogenous and/or exogenous nucleic acid molecule encoding a thiolase or an acetyl-CoA acetyltransferase that catalyzes the production of acetoacetyl-CoA from acetyl-CoA;
(b) at least one endogenous and/or exogenous nucleic acid molecule encoding an acetoacetyl-CoA synthase that catalyzes the production of acetoacetyl-CoA from malonyl-CoA;
(c) at least one endogenous and/or exogenous nucleic acid molecule encoding an acetoacetyl-CoA transferase that catalyzes the production of acetoacetate from acetoacetryl-CoA;
(d) at least one endogenous and/or exogenous nucleic acid molecule encoding a
    (i) hydroxymethylglutaryl-CoA synthase that catalyzes the production of HMG-CoA from acetoacetyl-CoA, and
    (ii) hydroxymethylglutaryl-CoA lyase that catalyzes the production of acetoacetate from HMG-CoA; and
(e) at least one endogenous and/or exogenous nucleic acid molecule encoding an acetoacetate decarboxylase that catalyzes the production of acetone from acetoacetate.

14. The recombinant microorganism of claim 13, wherein the endogenous and/or exogenous nucleic acid molecule encoding a thiolase or an acetyl-CoA acetyltransferase encodes an amino acid sequence comprising ERG10 (SEQ ID NO: 209), thlA (SEQ ID NO: 210), atoB (SEQ ID NO: 211), H16_B0759 (SEQ ID NO: 212), Msed_0656 (SEQ ID NO: 213), or AAT1 (SEQ ID NO: 214).

15. The recombinant microorganism of claim 13, wherein the endogenous and/or exogenous nucleic acid molecule encoding a acetoacetyl-CoA transferase encodes an amino acid sequence comprising atoA/atoD (SEQ ID NO: 215 and 216), ctfA/ctfB (SEQ ID NO: 219 and 220), ctfA/ctfB (SEQ ID NO:221 and 222) or ctfA/ctfB (SEQ ID NO:223 and 224).

16. The recombinant microorganism of claim 13, wherein the endogenous and/or exogenous nucleic acid molecule encoding a hydroxymethylglutaryl-CoA synthase and a hydroxymethylglutaryl-CoA lyase encode an amino acid sequence comprising ERG13 (SEQ ID NO: 283) and yngG (SEQ ID NO: 284).

17. The recombinant microorganism of claim 13, wherein the endogenous and/or exogenous nucleic acid molecule encoding a acetoacetate decarboxylase encodes an amino acid sequence comprising Adc.Ca (SEQ ID NO: 225), Adc.Cbe (SEQ ID NO: 226), Adc (SEQ ID NO: 227), Adc (SEQ ID NO: 228), Adc (SEQ ID NO: 229) or Adc.Pp (SEQ ID NO: 230).

18. The recombinant microorganism of claim 1, wherein the recombinant microorganism co-produces 3-HP, and/or derivatives thereof, and acetyl-CoA in an anaerobic process.

19. The method of claim 11, wherein the recombinant microorganism co-produces 3-HP, and/or derivatives thereof, and acetyl-CoA in an anaerobic process.

* * * * *